US009409947B2

(12) United States Patent
Myasoedov et al.

(10) Patent No.: US 9,409,947 B2
(45) Date of Patent: Aug. 9, 2016

(54) METHOD FOR PRODUCING A RECOMBINANT PEPTIDE AND RESULTANT PEPTIDE

(71) Applicant: "IVIX" Ltd., Moscow (RU)

(72) Inventors: Nikolay Fedorovich Myasoedov, Moscow (RU); Lyudmila Alexandrovna Andreeva, Moscow (RU); Dmitriy Viktorovich Golikov, Moscow (RU)

(73) Assignee: "IVIX" LTD., Moscow (RU)

( * ) Notice: Subject to any disclaimer, the term of this patent is extended or adjusted under 35 U.S.C. 154(b) by 0 days.

(21) Appl. No.: 14/388,080

(22) PCT Filed: May 28, 2013

(86) PCT No.: PCT/RU2013/000433
§ 371 (c)(1),
(2) Date: Sep. 25, 2014

(87) PCT Pub. No.: WO2013/151467
PCT Pub. Date: Oct. 10, 2013

(65) Prior Publication Data
US 2015/0111837 A1    Apr. 23, 2015

(30) Foreign Application Priority Data
Mar. 28, 2012    (RU) ................ 2012111965

(51) Int. Cl.
| C07K 7/06 | (2006.01) |
| A61K 38/08 | (2006.01) |
| C07K 5/103 | (2006.01) |
| C07K 5/08 | (2006.01) |
| C07K 5/10 | (2006.01) |
| A61K 38/00 | (2006.01) |

(52) U.S. Cl.
CPC ............. *C07K 7/06* (2013.01); *C07K 5/0802* (2013.01); *C07K 5/1002* (2013.01); *C07K 5/1013* (2013.01); *A61K 38/00* (2013.01); *A61K 38/08* (2013.01)

(58) Field of Classification Search
None
See application file for complete search history.

(56) References Cited

U.S. PATENT DOCUMENTS

| 5,932,548 | A | 8/1999 | Deghenghi |
| 5,955,421 | A | 9/1999 | Deghenghi |
| 6,211,156 | B1 | 4/2001 | Argiolas et al. |
| 2009/0111161 | A1 | 4/2009 | Jones et al. |
| 2010/0095987 | A1 | 4/2010 | Jones et al. |
| 2010/0190722 | A1 | 7/2010 | Bevec et al. |
| 2010/0197572 | A1 | 8/2010 | Bevec et al. |
| 2010/0204143 | A1 | 8/2010 | Bevec et al. |
| 2010/0204148 | A1 | 8/2010 | Bevec et al. |
| 2010/0210534 | A1 | 8/2010 | Bevec |
| 2010/0210567 | A1 | 8/2010 | Bevec |
| 2010/0273700 | A1 | 10/2010 | Bevec et al. |
| 2010/0286028 | A1 | 11/2010 | Bevec et al. |
| 2011/0081711 | A1 | 4/2011 | Jones et al. |
| 2012/0129791 | A1 | 5/2012 | Myasoedov et al. |

FOREIGN PATENT DOCUMENTS

| CN | 101302246 | 11/2008 |
| EA | 013948 | 8/2010 |
| EA | 200900804 | 8/2010 |
| RU | 1124544 | 1/1995 |
| RU | 2 058 791 | 4/1996 |
| RU | 2 155 065 | 8/2000 |
| RU | 2 264 823 | 1/2004 |
| RU | 2 252 779 | 5/2005 |
| RU | 2 290 195 | 12/2006 |
| RU | 2 404 793 | 11/2010 |
| RU | 2411249 C2 * | 2/2011 |
| WO | WO 94/22460 | 10/1994 |
| WO | WO 01/34171 | 5/2001 |
| WO | WO 2009/033678 | 3/2009 |
| WO | WO 2009/058679 | 5/2009 |
| WO | WO 2013151467 A2 * | 10/2013 | ............... C07K 7/06 |

OTHER PUBLICATIONS

Shevchenko et al., "Synthesis of Tritium-Labeled Selank", Radiochemistry, 2006, vol. 48, No. 3, pp. 296-300.*
UniProtKB/Swiss-Prot: Q8WTQ1.2; D104A_HUMAN; Jul. 2015; pp. 1-3.*
Semple et al., "Duplication and selection in the evolution of primate _-defensin genes", Genome Biology, 2003, pp. R31.1-R31.11.*
Patil et al., "Cross-species analysis of the mammalian _-defensin gene family: presence of syntenic gene clusters and preferential expression in the male reproductive tract", Comparative Genomics, 2005, pp. 5-17.*
GenScript Peptide Calculator, Peptide Sequence TKP, obtained from https://www.genscript.com on Aug. 21, 2015.*
UniProtKB/Swiss-Prot: Q8WTQ1.2, 2015, pp. 1-3.*
Semion et al., "Antinociceptive action of the SP14 tetrapeptide and of some tuftsin analogs", Pol. J. Pharmacol Pharm., 1990, pp. 393-401.*
Dagan et al., "Tuftsin Analogues: Synthesis, Structure-Function Relationships, and Implications for Specificity of Tuftsin's Bioactivity", Journal of Medicinal Chemistry, 1986, pp. 1961-1968.*
Andreeva et al., "The Perspectives of Development of New Peptide Preparations for Clinical Use Which Have Anti-Infective and Immune-Modulating Activity", Infekc. immun., 2011, pp. 171-176.*
Nair et al., "Interactions of Radiolabeled Tuftsin with Human Neutrophils", Immunochemistry, 1978, pp. 901-907.*
Chipens et al., "Elongated and Cyclic Analogues of Tuftsin and Rigin", Peptides, Proceedings of the Sixteeth European Peptide Symposium, 1981, pp. 445-450.*
Ashmarin et al., "A Comparative Analysis of the Distribution of Glyprolines after Their Administration by Different Ways", Russian Journal of Bioorganic Chemistry, 2008, pp. 415-420.*

(Continued)

*Primary Examiner* — Lianko Garyu
(74) *Attorney, Agent, or Firm* — Troutman Sanders LLP

(57) ABSTRACT

The invention relates to peptides with the following general formula:

A-Thr-Lys-Pro-B-C-D-X, where:

A—0, Met, Met (O), Thr, Ala, His, Phe, Lys, Gly
B—0, Gly, Asp, Trp, Gln, Asn, Tyr, Pro, Arg
C—0, Arg, Phe, Tyr, Gly, His, Pro, Lys
D—0, Val, Gly, Tyr, Trp, Phe, His
X—OH, OCH$_3$, NH$_2$,
where 0 is no amino acid residue, provided that if A≠0, then B and/or C and/or D≠0, if B≠0, then C and/or D≠0,
excluding the peptides Phe-Thr-Lys-Pro-Gly (SEQ ID NO: 1), Thr-Lys-Pro-Pro-Arg (SEQ ID NO: 2), Thr-Lys-Pro-Arg-Gly (SEQ ID NO: 3).

36 Claims, 3 Drawing Sheets

(56) References Cited

OTHER PUBLICATIONS

Mezö et al.,"Synthesis, Conformation, and Immunoreactivity of New Carrier Molecules Based on Repeated Tuftsin-Like Sequence", Biopolymers, 2004, p. 645-656.*

Pavlov, T., "Anti-Ulcer Effects of Selank and Its Fragments", Abstract of Ph.D. Thesis, Moscow 2006, pp. 1-44.

Zolotarev et al., "Evenly Tritium-Labeled Peptides in Study of Peptide in Vivo and in Vitro Biodegradation", Russian Journal of Bioorganic Chemistry, 2006, vol. 32, No. 2, pp. 166-173. (corresponds to the Russian-language reference Zolotarev et al., Ravnomerno mechenie tritium peptide v issledovaniyah poi h biodegradacii in vivo i in vitro, Biooorganicheskaya Khimiya, 2006, 32(2):183-191.).

Arletti, et al. "Sexual impotence is associated with a reduced production of oxytocin and with an increased production of opioid peptides in the paraventricular nucleus of male rats" Neuroscience Letters 1997, 233:65-68.

Ashmarin, et al. "Natural and hybrid ("chimeric") stable regulatory glyproline peptides" Pathophysiology 2005, 11:179-185.

Cantor, et al. "Chronic fluoxetine inhibits sexual behavior in the male rat: reversal with oxytocin" Psychopharmacology 1999, 144:355-362.

Czabak-Garbacz, et al. "Influence of long-term treatment with tuftsin analogue TP-7 on the anxiety-phobic states and body weight" Pharmacological Reports 2006, 58:562-567.

Diamond et al. Co-administration of low doses of intranasal PT-141, a melanocortin receptor agonist, and sildenafil to men with erectile dysfunction results in an enhanced erectile response, Urology, 2005, 65(4):755-759.

English-language abstract of Chinese Patent Publication No. CN101302246; Database WPI, Week 200912, Thompson Scientific, London, GB; AN 2009-B41118 XP002686138, & CN 101 302 246 A (Inst Toxicant & Medicament Acad Military) Nov. 12, 2008 Abstract.

International Preliminary Report on Patentability dated Dec. 6, 2011, which issued during prosecution of International Application No. PCT/RU2010/000285.

International Search Report dated Sep. 18, 2013, which issued during prosecution of International Application No. PCT/RU2013/000433, which corresponds to the present application.

International Search Report dated Sep. 23, 2010, which issued during prosecution of International Application No. PCT/RU2010/000285.

Kolomin, et al. "Expression of inflammation-related genes in mouse spleen under tuftsin analog Selank" Regulatory Peptides 2011, 170:18-23.

Kozlovskaya, et al. "A Comparative Study of the Effect of Tuftsin Fragments on Passive Avoidance Learning Characteristics" Pharmaceutical Chemistry Journal 2001, 35(3):121-123. (Translation of C12).

Kozlovskaya, et al. "Comparison study of series of tuftsin's fragments of short-time and durable action on the index of conditional reactions of passive avoidance" Chimiko-pharmac. Zh. 35 (2001), 3-5.

Kozlovskaya, et al. "Selank and short peptides of the Tuftsin Family in the Regulation of Adaptive Behavior in Stress" Neuroscience and Behavioral Physiology 2003, 33(9): 853-860. (Translation of C14).

Kozlovskaya, et al. "Selanc and Small peptides of Tuftsin derivatives in regulation of adaptive regulation of adaptive behavior of animal in stress" Ross. Fiziol. Zh. I. M. Sechenova. 88 (2002), 751-761.

Kumar et al. "Sexual Behaviour in Normal and Neurotic Females" Indian J. Psychiat. 1984, 26(3):213-218.

Semenova, et al. "Use of Selank to Correct Measures of Integrative Brain Activity and Biogenic Amine Levels in Adult Rats Resulting from Antenatal Hypoxia" Neuroscience and Behavioral Physiology 2008, 38(2):203-207 (Translated from Rossiiskii Fiziologicheskii Zhurnal imeni I. M. Sechenova, vol. 92, No. 11, pp. 1332-1338, 2006).

Seredinin et al., "The Study of Anxiolytic Activity of Tuftsin Analogue in Inbred Mice With Different Types of Emotional-Stress Reaction" Institute of Pharmacology, Russian Academy of Medical Sciences, Moscow, Zhurnal VND, 1998, 48(1):153-160.(English Translation of the full article provided).

Sollertinskaya, et al. "Compensatory and Antiamnestic Effects of Heptapeptide Selank in Monkeys" Journal of Evolutionary Biochemistry and Physiology 2008, 44(3):332-340.

Supplementary European Search Report dated Nov. 15, 2012, which issued during prosecution of EP 10783644.7.

* cited by examiner

METHOD FOR PRODUCING A RECOMBINANT PEPTIDE AND RESULTANT PEPTIDE

CROSS REFERENCE TO RELATED APPLICATIONS

This application is a U.S. National Phase Application under 35 U.S.C. §371 of International Patent Application No. PCT/RU2013/000433 filed May 28, 2013, which claims priority to Russian Patent Application No. 2012111965 filed Mar. 28, 2012. The International Application was published on Oct. 10, 2013, as International Publication No. WO 2013/151467 under PCT Article 21(2). The entire contents of these applications are hereby incorporated by reference.

SEQUENCE LISTING

The instant application contains a Sequence Listing which has been submitted electronically in ASCII format and is hereby incorporated by reference in its entirety. Said ASCII copy, created on Dec. 8, 2014, is named 246273.000002_SL.txt and is 559,963 bytes in size.

FIELD OF INVENTION

The invention relates to the field of biochemistry and concerns of recombinant method for production of peptides and the resulting peptides. In particular, the invention relates to peptides with the following general formula:

A-Thr-Lys-Pro-B-C-D-X, where:
A—0, Met, Met (O), Thr, Ala, His, Phe, Lys, Gly
B—0, Gly, Asp, Trp, Gln, Asn, Tyr, Pro, Arg
C—0, Arg, Phe, Tyr, Gly, His, Pro, Lys
D—0, Val, Gly, Tyr, Trp, Phe, His
X—OH, OCH$_3$, NH$_2$,
where 0 is no amino acid residue, provided that if A≠0, then B and/or C and/or D≠0, if B≠0, then C and/or D≠0, excluding the peptides Phe-Thr-Lys-Pro-Gly (SEQ ID NO: 1), Thr-Lys-Pro-Pro-Arg (SEQ ID NO: 2), Thr-Lys-Pro-Arg-Gly (SEQ ID NO: 3).

BACKGROUND OF THE INVENTION

It is known that small peptides exhibit extremely high activity, stimulating self-healing in the organs where a disturbance occurred. As it is commonly known, smaller peptides were initially derived from animal tissues, and later they learned to produce them in laboratory conditions.

Medicinal products containing peptides are capable of restoring damaged body cells, returning lost functions to the affected organ, and rejuvenating it. Medicinal products containing peptides were developed more than three decades ago; since that time, hundreds of experiments have been performed, which proved the efficacy of peptides in treatment and prevention of diseases of various body systems, as well as individual organ- and all-body rejuvenation.

In the body, peptides serve as information messengers: they transfer information from one cell to another, so that everything could be done well and on time. If one cell functions properly, then the corresponding organ operates well. If a malfunction occurs, it affects the whole organ, leading to a disease. Clearly, it is possible to treat the disease by introducing missing substances into the body, but this approach would completely 'spoil' the cell, and it would stop functioning properly. Therefore, it is necessary to send peptide messengers to the cell, which will make it function, so that the body would heal itself. Each organ has a supply of reserve stem cells. If this supply is spent evenly, one lives to the age of 100-110. Peptides are the same for all mammals. Therefore, if a calf peptide is introduced to a human, their body will take it as native molecule. The main problem was to find how to isolate peptides from animal organs. This technology was invented by Prof. Vladimir Morozov and Prof. Vyacheslav Havinson in Military Medical Academy as early as in 1971. Medicinal products were developed, and then, based on them, dietary supplements were made, because dietary supplements are easy to use. In their studies of aging processes and methods to influence it, employees of St. Petersburg Institute of Gerontology concluded that introduction of peptides into the diet of experimental group of mice increased their life expectancy by 30-38%. Later, studies of peptides were performed on the elderly in Kiev Institute of Gerontology and in St. Petersburg. This showed almost 2-fold reduction of mortality rate, indicating high geroprotective activity of peptides. Long-term study and use of peptide medicinal products showed their high efficacy in patients of different age groups; however, particular efficacy was observed in elderly (over 50 years old). Absolute advantage of peptide bioregulators is absence of any adverse reactions. Within 26 years, more than 15 min. people with various pathologies received such products. Their efficacy averaged to 75-95%. Peptide deficit, developing with age and pathologic changes, significantly accelerates tissue wear and body aging. The fact is that an adequate functioning of cells and tissues requires adequate amounts of peptides, which, in turn, support optimal gene operation. Peptides, functioning in cells specific for them, are synthesized there. Therefore, in pathological changes, as well as with age, cell functioning is disrupted; hence, peptide reproduction is affected as well. Consequently, cell function is affected secondarily. Thus, degeneration of tissues progresses, which eventually is manifested clinically. So, application of small peptides is one of the major innovations in medicine and can significantly slow down the rate of aging by stimulating cell proliferation and tissue regeneration, as well as enhancing cell life span. Another important advantage of peptides is their antitumor action. Currently, the use of peptides is the best and uncompromising solution in revitalization (body rejuvenation) and cancer prevention, because it allows to rejuvenate cells and tissues not only by regulation and synchronization of all cyclic processes, but also by increasing the capacity of cell division without atypia (atypia is an incorrect cell structure, or abnormality).

Of course, at the present stage of art, small peptide production from animal tissues is impractical, since this method is very expensive, not to mention the humanity of the production process.

A modern and advanced production method comprises using recombinant microorganisms. Most convenient microorganism is *E. coli*. Commercial strains of *E. coli*, suitable for use in laboratory conditions, such as *E. coli* K12, *E. coli* 0104, are known in the prior art. These and similar known *E. coli* strains can be used to obtain strains producing small peptides claimed. A nucleic acid, encoding the corresponding target small peptide, can be integrated in any known strain, suitable for use in the laboratory conditions. Vectors, such as bacterial plasmids, viruses, virions, hybrid vectors containing phage DNA, and plasmids, are used to insert DNA into a host cell. These vectors include, for example, cosmids and phasmids.

Furthermore, it is possible to produce peptides by conventional chemical synthesis.

Proposed peptides solve the problem of expanding the range of tools for stimulation of reproductive and sexual function and treatment of reproductive and sexual dysfunction, which remains relevant now. Currently, pathogenetic treatment of such pathologies is performed using psychotherapy, antidepressants, anxiolytics, adaptogens, as well as vitamins, common plant-based stimulants, and diet supplements. Such treatment is long, inefficient and accompanied by many side effects.

One of the most effective classes of physiologically active substances, suitable for production of stimulants of reproductive and sexual function, is peptides, which, as endogenous substances, have virtually no negative side effects.

Our own research showed that heptapeptide Selank with the general formula of Thr-Lys-Pro-Arg-Pro-Gly-Pro (SEQ ID NO: 2680), a synthetic analog of the endogenously produced peptide Tuftsin, can be used as a tool for prevention and treatment of reproductive and sexual dysfunction (Patent of Russian Federation No 2404793). However, the synthesis of heptapeptide Selank is multistage, which greatly increases the cost of medicinal products based on it; moreover, it is exposed to intense proteolysis in the body, which reduces its stimulating effect on prevention and treatment of reproductive and sexual dysfunction.

DISCLOSURE OF INVENTION

The aim of the invention is to expand the range of tools with reproductive- and sexual-function stimulating activity.

Technical result, achieved when implementing the present invention, is an increase in efficacy of prevention and treatment of reproductive and sexual dysfunction, reduction in duration of course therapy, and cost reduction of medications, where peptides with the following general formula are proposed as a medicinal product:

A-Thr-Lys-Pro-B-C-D-X, where:

A—0, Met, Met (O), Thr, Ala, His, Phe, Lys, Gly
B—0, Gly, Asp, Tip, Gln, Asn, Tyr, Pro, Arg
C—0, Arg, Phe, Tyr, Gly, His, Pro, Lys
D—0, Val, Gly, Tyr, Trp, Phe, His
X—OH, OCH$_3$, NH$_2$,
where 0 means no amino acid residue.

Provided that if A≠0, then B and/or C and/or D≠0; if B≠0, then C and/or D≠0, excluding peptides Phe-Thr-Lys-Pro-Gly (SEQ ID NO: 1), Thr-Lys-Pro-Pro-Arg (SEQ ID NO: 2), Thr-Lys-Pro-Arg-Gly (SEQ ID NO: 3).

Selection of amino acid residues at positions A, B, C, D, and X is based on a bioinformatic analysis of amino acid residue frequency at corresponding positions of N-terminal and C-terminal amino acid residues in the database [EROP-Moscow (erop.inbi.ras.ru/) Zamyatin A. A. EROP-Moscow: Specialized data bank for endogenous regulatory oligopeptides, Protein Sequence and Data Analysis, 4(1), 49-52, 1991; Zamyatnin A. A. et al., The EROP-Moscow oligopeptide database. Nucleic Acids Research, 34(Database issue), D261-D266, 2006]. Selection of these amino acid residues was performed based on the criterion of greater than 50% incidence of an amino acid residue at that position. This sample of amino acid residues was experimentally confirmed by synthesis of individual peptides and their test for stimulation of reproductive- and sexual-function activity in models in vivo. Pharmacophore position in a peptide is determined experimentally. It is known that any peptide is exposed to peptidases and breaks down into specific fragments. For this purpose, following Selank heptapeptide fragments were synthesized: Thr-Lys (SEQ ID NO: 2678), Thr-Lys-Pro (SEQ ID NO: 5), Pro-Gly-Pro (SEQ ID NO: 2677), Arg-Pro-Gly-Pro (SEQ ID NO: 2676), Pro-Arg-Pro-Gly-Pro (SEQ ID NO: 2675), and their activity was studied. Results are provided in Table 4. In this analysis, pharmacophore was determined: it is Thr-Lys-Pro (SEQ ID NO: 5). It was shown that attachment of individual experimentally identified amino acid residues to the C-terminus maintained the peptide's activity (stimulating reproductive and sexual function) provided that the number of amino acid residues in the peptide is 3 or more than 4, as shown by studies (Table 5, Example 10). Tetrapeptides do not have reproductive and sexual-function stimulating activity.

Mentioned technical result is achieved by directed synthesis of various peptides with the general formula A-Thr-Lys-Pro-B-C-D-X (except tetrapeptides) and by using these peptides as a stimulant of reproductive and sexual function for prevention and treatment of reproductive and sexual dysfunction. Our own research showed that synthesized peptides, i.e. Thr-Lys-Pro tripeptide (SEQ ID NO: 5), Thr-Lys-Pro-Arg-Pro pentapeptide (SEQ ID NO: 6), and Thr-Lys-Pro-Arg-Pro-Phe hexapeptide (SEQ ID NO: 7), corresponding to the general formula A-Thr-Lys-Pro-B-C-D-X, can be recommended as stimulants of reproductive and sexual function.

All peptides with the general formula A-Thr-Lys-Pro-B-C-D-X (except tetrapeptides), recommended as stimulants of reproductive and sexual function, have a common pattern, i.e. Thr-Lys-Pro tripeptide molecule is present in their molecular structure.

Thr-Lys-Pro-Arg-Pro-Gly-Pro (SEQ ID NO: 2680) heptapeptide (Selank) was used as a control. Results of conducted studies showed that peptides with the general formula A-Thr-Lys-Pro-B-C-D-X (except tetrapeptides) have reproductive- and sexual-function stimulating activity and can be used as medicinal products for prevention and treatment of reproductive and sexual dysfunction.

Some peptides of the general formula A-Thr-Lys-Pro-B-C-D-X are shown in Table 1.

TABLE 1

| X-OH | X-OCH$_3$ | X-NH$_2$ | SEQ ID NO |
|---|---|---|---|
| Thr-Lys-Pro | Thr-Lys-Pro | Thr-Lys-Pro | 5 |
| Thr-Lys-Pro-Arg-His | Thr-Lys-Pro-Arg-His | Thr-Lys-Pro-Arg-His | 8 |
| Thr-Lys-Pro-Phe-His | Thr-Lys-Pro-Phe-His | Thr-Lys-Pro-Phe-His | 9 |
| Thr-Lys-Pro-Tyr-His | Thr-Lys-Pro-Tyr-His | Thr-Lys-Pro-Tyr-His | 10 |
| Thr-Lys-Pro-Gly-His | Thr-Lys-Pro-Gly-His | Thr-Lys-Pro-Gly-His | 11 |
| Thr-Lys-Pro-His-His | Thr-Lys-Pro-His-His | Thr-Lys-Pro-His-His | 12 |

TABLE 1-continued

| X-OH | X-OCH₃ | X-NH₂ | SEQ ID NO |
|---|---|---|---|
| Thr-Lys-Pro-Lys-His | Thr-Lys-Pro-Lys-His | Thr-Lys-Pro-Lys-His | 13 |
| Thr-Lys-Pro-Gly-His | Thr-Lys-Pro-Gly-His | Thr-Lys-Pro-Gly-His | 14 |
| Thr-Lys-Pro-Gly-Arg-His | Thr-Lys-Pro-Gly-Arg-His | Thr-Lys-Pro-Gly-Arg-His | 15 |
| Thr-Lys-Pro-Gly-Phe-His | Thr-Lys-Pro-Gly-Phe-His | Thr-Lys-Pro-Gly-Phe-His | 16 |
| Thr-Lys-Pro-Gly-Tyr-His | Thr-Lys-Pro-Gly-Tyr-His | Thr-Lys-Pro-Gly-Tyr-His | 17 |
| Thr-Lys-Pro-Gly-His-His | Thr-Lys-Pro-Gly-His-His | Thr-Lys-Pro-Gly-His-His | 18 |
| Thr-Lys-Pro-Gly-Pro-His | Thr-Lys-Pro-Gly-Pro-His | Thr-Lys-Pro-Gly-Pro-His | 19 |
| Thr-Lys-Pro-Gly-Lys-His | Thr-Lys-Pro-Gly-Lys-His | Thr-Lys-Pro-Gly-Lys-His | 20 |
| Thr-Lys-Pro-Asp-His | Thr-Lys-Pro-Asp-His | Thr-Lys-Pro-Asp-His | 21 |
| Thr-Lys-Pro-Asp-Arg-His | Thr-Lys-Pro-Asp-Arg-His | Thr-Lys-Pro-Asp-Arg-His | 22 |
| Thr-Lys-Pro-Asp-Phe-His | Thr-Lys-Pro-Asp-Phe-His | Thr-Lys-Pro-Asp-Phe-His | 23 |
| Thr-Lys-Pro-Asp-Tyr-His | Thr-Lys-Pro-Asp-Tyr-His | Thr-Lys-Pro-Asp-Tyr-His | 24 |
| Thr-Lys-Pro-Asp-His-His | Thr-Lys-Pro-Asp-His-His | Thr-Lys-Pro-Asp-His-His | 25 |
| Thr-Lys-Pro-Asp-Pro-His | Thr-Lys-Pro-Asp-Pro-His | Thr-Lys-Pro-Asp-Pro-His | 26 |
| Thr-Lys-Pro-Asp-Lys-His | Thr-Lys-Pro-Asp-Lys-His | Thr-Lys-Pro-Asp-Lys-His | 27 |
| Thr-Lys-Pro-Trp-His | Thr-Lys-Pro-Trp-His | Thr-Lys-Pro-Trp-His | 28 |
| Thr-Lys-Pro-Trp-Arg-His | Thr-Lys-Pro-Trp-Arg-His | Thr-Lys-Pro-Trp-Arg-His | 29 |
| Thr-Lys-Pro-Trp-Phe-His | Thr-Lys-Pro-Trp-Phe-His | Thr-Lys-Pro-Trp-Phe-His | 30 |
| Thr-Lys-Pro-Trp-Tyr-His | Thr-Lys-Pro-Trp-Tyr-His | Thr-Lys-Pro-Trp-Tyr-His | 31 |
| Thr-Lys-Pro-Trp-His-His | Thr-Lys-Pro-Trp-His-His | Thr-Lys-Pro-Trp-His-His | 32 |
| Thr-Lys-Pro-Trp-Pro-His | Thr-Lys-Pro-Trp-Pro-His | Thr-Lys-Pro-Trp-Pro-His | 33 |
| Thr-Lys-Pro-Trp-Lys-His | Thr-Lys-Pro-Trp-Lys-His | Thr-Lys-Pro-Trp-Lys-His | 34 |
| Thr-Lys-Pro-Gln-His | Thr-Lys-Pro-Gln-His | Thr-Lys-Pro-Gln-His | 35 |
| Thr-Lys-Pro-Gln-Arg-His | Thr-Lys-Pro-Gln-Arg-His | Thr-Lys-Pro-Gln-Arg-His | 36 |
| Thr-Lys-Pro-Gln-Phe-His | Thr-Lys-Pro-Gln-Phe-His | Thr-Lys-Pro-Gln-Phe-His | 37 |
| Thr-Lys-Pro-Gln-Tyr-His | Thr-Lys-Pro-Gln-Tyr-His | Thr-Lys-Pro-Gln-Tyr-His | 38 |
| Thr-Lys-Pro-Gln-His-His | Thr-Lys-Pro-Gln-His-His | Thr-Lys-Pro-Gln-His-His | 39 |
| Thr-Lys-Pro-Gln-Pro-His | Thr-Lys-Pro-Gln-Pro-His | Thr-Lys-Pro-Gln-Pro-His | 40 |
| Thr-Lys-Pro-Gln-Lys-His | Thr-Lys-Pro-Gln-Lys-His | Thr-Lys-Pro-Gln-Lys-His | 41 |
| Thr-Lys-Pro-Asn-His | Thr-Lys-Pro-Asn-His | Thr-Lys-Pro-Asn-His | 42 |
| Thr-Lys-Pro-Asn-Arg-His | Thr-Lys-Pro-Asn-Arg-His | Thr-Lys-Pro-Asn-Arg-His | 43 |
| Thr-Lys-Pro-Asn-Phe-His | Thr-Lys-Pro-Asn-Phe-His | Thr-Lys-Pro-Asn-Phe-His | 44 |
| Thr-Lys-Pro-Asn-Tyr-His | Thr-Lys-Pro-Asn-Tyr-His | Thr-Lys-Pro-Asn-Tyr-His | 45 |
| Thr-Lys-Pro-Asn-His-His | Thr-Lys-Pro-Asn-His-His | Thr-Lys-Pro-Asn-His-His | 46 |
| Thr-Lys-Pro-Asn-Pro-His | Thr-Lys-Pro-Asn-Pro-His | Thr-Lys-Pro-Asn-Pro-His | 47 |
| Thr-Lys-Pro-Asn-Lys-His | Thr-Lys-Pro-Asn-Lys-His | Thr-Lys-Pro-Asn-Lys-His | 48 |
| Thr-Lys-Pro-Tyr-His | Thr-Lys-Pro-Tyr-His | Thr-Lys-Pro-Tyr-His | 49 |
| Thr-Lys-Pro-Tyr-Arg-His | Thr-Lys-Pro-Tyr-Arg-His | Thr-Lys-Pro-Tyr-Arg-His | 50 |

TABLE 1-continued

| X-OH | X-OCH$_3$ | X-NH$_2$ | SEQ ID NO |
|---|---|---|---|
| Thr-Lys-Pro-Tyr-Phe-His | Thr-Lys-Pro-Tyr-Phe-His | Thr-Lys-Pro-Tyr-Phe-His | 51 |
| Thr-Lys-Pro-Tyr-Tyr-His | Thr-Lys-Pro-Tyr-Tyr-His | Thr-Lys-Pro-Tyr-Tyr-His | 52 |
| Thr-Lys-Pro-Tyr-His-His | Thr-Lys-Pro-Tyr-His-His | Thr-Lys-Pro-Tyr-His-His | 53 |
| Thr-Lys-Pro-Tyr-Pro-His | Thr-Lys-Pro-Tyr-Pro-His | Thr-Lys-Pro-Tyr-Pro-His | 54 |
| Thr-Lys-Pro-Tyr-Lys-His | Thr-Lys-Pro-Tyr-Lys-His | Thr-Lys-Pro-Tyr-Lys-His | 55 |
| Thr-Lys-Pro-Arg-His | Thr-Lys-Pro-Arg-His | Thr-Lys-Pro-Arg-His | 56 |
| Thr-Lys-Pro-Arg-Arg-His | Thr-Lys-Pro-Arg-Arg-His | Thr-Lys-Pro-Arg-Arg-His | 57 |
| Thr-Lys-Pro-Arg-Phe-His | Thr-Lys-Pro-Arg-Phe-His | Thr-Lys-Pro-Arg-Phe-His | 58 |
| Thr-Lys-Pro-Arg-Tyr-His | Thr-Lys-Pro-Arg-Tyr-His | Thr-Lys-Pro-Arg-Tyr-His | 59 |
| Thr-Lys-Pro-Arg-His-His | Thr-Lys-Pro-Arg-His-His | Thr-Lys-Pro-Arg-His-His | 60 |
| Thr-Lys-Pro-Arg-Pro-His | Thr-Lys-Pro-Arg-Pro-His | Thr-Lys-Pro-Arg-Pro-His | 61 |
| Thr-Lys-Pro-Arg-Lys-His | Thr-Lys-Pro-Arg-Lys-His | Thr-Lys-Pro-Arg-Lys-His | 62 |
| Met-Thr-Lys-Pro-His | Met-Thr-Lys-Pro-His | Met-Thr-Lys-Pro-His | 63 |
| Met-Thr-Lys-Pro-Arg-His | Met-Thr-Lys-Pro-Arg-His | Met-Thr-Lys-Pro-Arg-His | 64 |
| Met-Thr-Lys-Pro-Phe-His | Met-Thr-Lys-Pro-Phe-His | Met-Thr-Lys-Pro-Phe-His | 65 |
| Met-Thr-Lys-Pro-Tyr-His | Met-Thr-Lys-Pro-Tyr-His | Met-Thr-Lys-Pro-Tyr-His | 66 |
| Met-Thr-Lys-Pro-Gly-His | Met-Thr-Lys-Pro-Gly-His | Met-Thr-Lys-Pro-Gly-His | 67 |
| Met-Thr-Lys-Pro-His-His | Met-Thr-Lys-Pro-His-His | Met-Thr-Lys-Pro-His-His | 68 |
| Met-Thr-Lys-Pro-Lys-His | Met-Thr-Lys-Pro-Lys-His | Met-Thr-Lys-Pro-Lys-His | 69 |
| Met-Thr-Lys-Pro-Gly-His | Met-Thr-Lys-Pro-Gly-His | Met-Thr-Lys-Pro-Gly-His | 70 |
| Met-Thr-Lys-Pro-Gly-Arg-His | Met-Thr-Lys-Pro-Gly-Arg-His | Met-Thr-Lys-Pro-Gly-Arg-His | 71 |
| Met-Thr-Lys-Pro-Gly-Phe-His | Met-Thr-Lys-Pro-Gly-Phe-His | Met-Thr-Lys-Pro-Gly-Phe-His | 72 |
| Met-Thr-Lys-Pro-Gly-Tyr-His | Met-Thr-Lys-Pro-Gly-Tyr-His | Met-Thr-Lys-Pro-Gly-Tyr-His | 73 |
| Met-Thr-Lys-Pro-Gly-His-His | Met-Thr-Lys-Pro-Gly-His-His | Met-Thr-Lys-Pro-Gly-His-His | 74 |
| Met-Thr-Lys-Pro-Gly-Pro-His | Met-Thr-Lys-Pro-Gly-Pro-His | Met-Thr-Lys-Pro-Gly-Pro-His | 75 |
| Met-Thr-Lys-Pro-Gly-Lys-His | Met-Thr-Lys-Pro-Gly-Lys-His | Met-Thr-Lys-Pro-Gly-Lys-His | 76 |
| Met-Thr-Lys-Pro-Asp-His | Met-Thr-Lys-Pro-Asp-His | Met-Thr-Lys-Pro-Asp-His | 77 |
| Met-Thr-Lys-Pro-Asp-Arg-His | Met-Thr-Lys-Pro-Asp-Arg-His | Met-Thr-Lys-Pro-Asp-Arg-His | 78 |
| Met-Thr-Lys-Pro-Asp-Phe-His | Met-Thr-Lys-Pro-Asp-Phe-His | Met-Thr-Lys-Pro-Asp-Phe-His | 79 |
| Met-Thr-Lys-Pro-Asp-Tyr-His | Met-Thr-Lys-Pro-Asp-Tyr-His | Met-Thr-Lys-Pro-Asp-Tyr-His | 80 |
| Met-Thr-Lys-Pro-Asp-His-His | Met-Thr-Lys-Pro-Asp-His-His | Met-Thr-Lys-Pro-Asp-His-His | 81 |
| Met-Thr-Lys-Pro-Asp-Pro-His | Met-Thr-Lys-Pro-Asp-Pro-His | Met-Thr-Lys-Pro-Asp-Pro-His | 82 |
| Met-Thr-Lys-Pro-Asp-Lys-His | Met-Thr-Lys-Pro-Asp-Lys-His | Met-Thr-Lys-Pro-Asp-Lys-His | 83 |
| Met-Thr-Lys-Pro-Trp-His | Met-Thr-Lys-Pro-Trp-His | Met-Thr-Lys-Pro-Trp-His | 84 |
| Met-Thr-Lys-Pro-Trp-Arg-His | Met-Thr-Lys-Pro-Trp-Arg-His | Met-Thr-Lys-Pro-Trp-Arg-His | 85 |
| Met-Thr-Lys-Pro-Trp-Phe-His | Met-Thr-Lys-Pro-Trp-Phe-His | Met-Thr-Lys-Pro-Trp-Phe-His | 86 |
| Met-Thr-Lys-Pro-Trp-Tyr-His | Met-Thr-Lys-Pro-Trp-Tyr-His | Met-Thr-Lys-Pro-Trp-Tyr-His | 87 |
| Met-Thr-Lys-Pro-Trp-His-His | Met-Thr-Lys-Pro-Trp-His-His | Met-Thr-Lys-Pro-Trp-His-His | 88 |

TABLE 1-continued

| X-OH | X-OCH₃ | X-NH₂ | SEQ ID NO |
|---|---|---|---|
| Met-Thr-Lys-Pro-Trp-Pro-His | Met-Thr-Lys-Pro-Trp-Pro-His | Met-Thr-Lys-Pro-Trp-Pro-His | 89 |
| Met-Thr-Lys-Pro-Trp-Lys-His | Met-Thr-Lys-Pro-Trp-Lys-His | Met-Thr-Lys-Pro-Trp-Lys-His | 90 |
| Met-Thr-Lys-Pro-Gln-His | Met-Thr-Lys-Pro-Gln-His | Met-Thr-Lys-Pro-Gln-His | 91 |
| Met-Thr-Lys-Pro-Gln-Arg-His | Met-Thr-Lys-Pro-Gln-Arg-His | Met-Thr-Lys-Pro-Gln-Arg-His | 92 |
| Met-Thr-Lys-Pro-Gln-Phe-His | Met-Thr-Lys-Pro-Gln-Phe-His | Met-Thr-Lys-Pro-Gln-Phe-His | 93 |
| Met-Thr-Lys-Pro-Gln-Tyr-His | Met-Thr-Lys-Pro-Gln-Tyr-His | Met-Thr-Lys-Pro-Gln-Tyr-His | 94 |
| Met-Thr-Lys-Pro-Gln-His-His | Met-Thr-Lys-Pro-Gln-His-His | Met-Thr-Lys-Pro-Gln-His-His | 95 |
| Met-Thr-Lys-Pro-Gln-Pro-His | Met-Thr-Lys-Pro-Gln-Pro-His | Met-Thr-Lys-Pro-Gln-Pro-His | 96 |
| Met-Thr-Lys-Pro-Gln-Lys-His | Met-Thr-Lys-Pro-Gln-Lys-His | Met-Thr-Lys-Pro-Gln-Lys-His | 97 |
| Met-Thr-Lys-Pro-Asn-His | Met-Thr-Lys-Pro-Asn-His | Met-Thr-Lys-Pro-Asn-His | 98 |
| Met-Thr-Lys-Pro-Asn-Arg-His | Met-Thr-Lys-Pro-Asn-Arg-His | Met-Thr-Lys-Pro-Asn-Arg-His | 99 |
| Met-Thr-Lys-Pro-Asn-Phe-His | Met-Thr-Lys-Pro-Asn-Phe-His | Met-Thr-Lys-Pro-Asn-Phe-His | 100 |
| Met-Thr-Lys-Pro-Asn-Tyr-His | Met-Thr-Lys-Pro-Asn-Tyr-His | Met-Thr-Lys-Pro-Asn-Tyr-His | 101 |
| Met-Thr-Lys-Pro-Asn-His-His | Met-Thr-Lys-Pro-Asn-His-His | Met-Thr-Lys-Pro-Asn-His-His | 102 |
| Met-Thr-Lys-Pro-Asn-Pro-His | Met-Thr-Lys-Pro-Asn-Pro-His | Met-Thr-Lys-Pro-Asn-Pro-His | 103 |
| Met-Thr-Lys-Pro-Asn-Lys-His | Met-Thr-Lys-Pro-Asn-Lys-His | Met-Thr-Lys-Pro-Asn-Lys-His | 104 |
| Met-Thr-Lys-Pro-Tyr-His | Met-Thr-Lys-Pro-Tyr-His | Met-Thr-Lys-Pro-Tyr-His | 105 |
| Met-Thr-Lys-Pro-Tyr-Arg-His | Met-Thr-Lys-Pro-Tyr-Arg-His | Met-Thr-Lys-Pro-Tyr-Arg-His | 106 |
| Met-Thr-Lys-Pro-Tyr-Phe-His | Met-Thr-Lys-Pro-Tyr-Phe-His | Met-Thr-Lys-Pro-Tyr-Phe-His | 107 |
| Met-Thr-Lys-Pro-Tyr-Tyr-His | Met-Thr-Lys-Pro-Tyr-Tyr-His | Met-Thr-Lys-Pro-Tyr-Tyr-His | 108 |
| Met-Thr-Lys-Pro-Tyr-His-His | Met-Thr-Lys-Pro-Tyr-His-His | Met-Thr-Lys-Pro-Tyr-His-His | 109 |
| Met-Thr-Lys-Pro-Tyr-Pro-His | Met-Thr-Lys-Pro-Tyr-Pro-His | Met-Thr-Lys-Pro-Tyr-Pro-His | 110 |
| Met-Thr-Lys-Pro-Tyr-Lys-His | Met-Thr-Lys-Pro-Tyr-Lys-His | Met-Thr-Lys-Pro-Tyr-Lys-His | 111 |
| Met-Thr-Lys-Pro-Arg-His | Met-Thr-Lys-Pro-Arg-His | Met-Thr-Lys-Pro-Arg-His | 112 |
| Met-Thr-Lys-Pro-Arg-Arg-His | Met-Thr-Lys-Pro-Arg-Arg-His | Met-Thr-Lys-Pro-Arg-Arg-His | 113 |
| Met-Thr-Lys-Pro-Arg-Phe-His | Met-Thr-Lys-Pro-Arg-Phe-His | Met-Thr-Lys-Pro-Arg-Phe-His | 114 |
| Met-Thr-Lys-Pro-Arg-Tyr-His | Met-Thr-Lys-Pro-Arg-Tyr-His | Met-Thr-Lys-Pro-Arg-Tyr-His | 115 |
| Met-Thr-Lys-Pro-Arg-His-His | Met-Thr-Lys-Pro-Arg-His-His | Met-Thr-Lys-Pro-Arg-His-His | 116 |
| Met-Thr-Lys-Pro-Arg-Pro-His | Met-Thr-Lys-Pro-Arg-Pro-His | Met-Thr-Lys-Pro-Arg-Pro-His | 117 |
| Met-Thr-Lys-Pro-Arg-Lys-His | Met-Thr-Lys-Pro-Arg-Lys-His | Met-Thr-Lys-Pro-Arg-Lys-His | 118 |
| Met(O)-Thr-Lys-Pro-His | Met(O)-Thr-Lys-Pro-His | Met(O)-Thr-Lys-Pro-His | 119 |
| Met(O)-Thr-Lys-Pro-Arg-His | Met(O)-Thr-Lys-Pro-Arg-His | Met(O)-Thr-Lys-Pro-Arg-His | 120 |
| Met(O)-Thr-Lys-Pro-Phe-His | Met(O)-Thr-Lys-Pro-Phe-His | Met(O)-Thr-Lys-Pro-Phe-His | 121 |
| Met(O)-Thr-Lys-Pro-Tyr-His | Met(O)-Thr-Lys-Pro-Tyr-His | Met(O)-Thr-Lys-Pro-Tyr-His | 122 |
| Met(O)-Thr-Lys-Pro-Gly-His | Met(O)-Thr-Lys-Pro-Gly-His | Met(O)-Thr-Lys-Pro-Gly-His | 123 |
| Met(O)-Thr-Lys-Pro-His-His | Met(O)-Thr-Lys-Pro-His-His | Met(O)-Thr-Lys-Pro-His-His | 124 |
| Met(O)-Thr-Lys-Pro-Lys-His | Met(O)-Thr-Lys-Pro-Lys-His | Met(O)-Thr-Lys-Pro-Lys-His | 125 |
| Met(O)-Thr-Lys-Pro-Gly-His | Met(O)-Thr-Lys-Pro-Gly-His | Met(O)-Thr-Lys-Pro-Gly-His | 126 |

TABLE 1-continued

| X-OH | X-OCH₃ | X-NH₂ | SEQ ID NO |
|---|---|---|---|
| Met(O)-Thr-Lys-Pro-Gly-Arg-His | Met(O)-Thr-Lys-Pro-Gly-Arg-His | Met(O)-Thr-Lys-Pro-Gly-Arg-His | 127 |
| Met(O)-Thr-Lys-Pro-Gly-Phe-His | Met(O)-Thr-Lys-Pro-Gly-Phe-His | Met(O)-Thr-Lys-Pro-Gly-Phe-His | 128 |
| Met(O)-Thr-Lys-Pro-Gly-Tyr-His | Met(O)-Thr-Lys-Pro-Gly-Tyr-His | Met(O)-Thr-Lys-Pro-Gly-Tyr-His | 129 |
| Met(O)-Thr-Lys-Pro-Gly-His-His | Met(O)-Thr-Lys-Pro-Gly-His-His | Met(O)-Thr-Lys-Pro-Gly-His-His | 130 |
| Met(O)-Thr-Lys-Pro-Gly-Pro-His | Met(O)-Thr-Lys-Pro-Gly-Pro-His | Met(O)-Thr-Lys-Pro-Gly-Pro-His | 131 |
| Met(O)-Thr-Lys-Pro-Gly-Lys-His | Met(O)-Thr-Lys-Pro-Gly-Lys-His | Met(O)-Thr-Lys-Pro-Gly-Lys-His | 132 |
| Met(O)-Thr-Lys-Pro-Asp-His | Met(O)-Thr-Lys-Pro-Asp-His | Met(O)-Thr-Lys-Pro-Asp-His | 133 |
| Met(O)-Thr-Lys-Pro-Asp-Arg-His | Met(O)-Thr-Lys-Pro-Asp-Arg-His | Met(O)-Thr-Lys-Pro-Asp-Arg-His | 134 |
| Met(O)-Thr-Lys-Pro-Asp-Phe-His | Met(O)-Thr-Lys-Pro-Asp-Phe-His | Met(O)-Thr-Lys-Pro-Asp-Phe-His | 135 |
| Met(O)-Thr-Lys-Pro-Asp-Tyr-His | Met(O)-Thr-Lys-Pro-Asp-Tyr-His | Met(O)-Thr-Lys-Pro-Asp-Tyr-His | 136 |
| Met(O)-Thr-Lys-Pro-Asp-His-His | Met(O)-Thr-Lys-Pro-Asp-His-His | Met(O)-Thr-Lys-Pro-Asp-His-His | 137 |
| Met(O)-Thr-Lys-Pro-Asp-Pro-His | Met(O)-Thr-Lys-Pro-Asp-Pro-His | Met(O)-Thr-Lys-Pro-Asp-Pro-His | 138 |
| Met(O)-Thr-Lys-Pro-Asp-Lys-His | Met(O)-Thr-Lys-Pro-Asp-Lys-His | Met(O)-Thr-Lys-Pro-Asp-Lys-His | 139 |
| Met(O)-Thr-Lys-Pro-Trp-His | Met(O)-Thr-Lys-Pro-Trp-His | Met(O)-Thr-Lys-Pro-Trp-His | 140 |
| Met(O)-Thr-Lys-Pro-Trp-Arg-His | Met(O)-Thr-Lys-Pro-Trp-Arg-His | Met(O)-Thr-Lys-Pro-Trp-Arg-His | 141 |
| Met(O)-Thr-Lys-Pro-Trp-Phe-His | Met(O)-Thr-Lys-Pro-Trp-Phe-His | Met(O)-Thr-Lys-Pro-Trp-Phe-His | 142 |
| Met(O)-Thr-Lys-Pro-Trp-Tyr-His | Met(O)-Thr-Lys-Pro-Trp-Tyr-His | Met(O)-Thr-Lys-Pro-Trp-Tyr-His | 143 |
| Met(O)-Thr-Lys-Pro-Trp-His-His | Met(O)-Thr-Lys-Pro-Trp-His-His | Met(O)-Thr-Lys-Pro-Trp-His-His | 144 |
| Met(O)-Thr-Lys-Pro-Trp-Pro-His | Met(O)-Thr-Lys-Pro-Trp-Pro-His | Met(O)-Thr-Lys-Pro-Trp-Pro-His | 145 |
| Met(O)-Thr-Lys-Pro-Trp-Lys-His | Met(O)-Thr-Lys-Pro-Trp-Lys-His | Met(O)-Thr-Lys-Pro-Trp-Lys-His | 146 |
| Met(O)-Thr-Lys-Pro-Gln-His | Met(O)-Thr-Lys-Pro-Gln-His | Met(O)-Thr-Lys-Pro-Gln-His | 147 |
| Met(O)-Thr-Lys-Pro-Gln-Arg-His | Met(O)-Thr-Lys-Pro-Gln-Arg-His | Met(O)-Thr-Lys-Pro-Gln-Arg-His | 148 |
| Met(O)-Thr-Lys-Pro-Gln-Phe-His | Met(O)-Thr-Lys-Pro-Gln-Phe-His | Met(O)-Thr-Lys-Pro-Gln-Phe-His | 149 |
| Met(O)-Thr-Lys-Pro-Gln-Tyr-His | Met(O)-Thr-Lys-Pro-Gln-Tyr-His | Met(O)-Thr-Lys-Pro-Gln-Tyr-His | 150 |
| Met(O)-Thr-Lys-Pro-Gln-His-His | Met(O)-Thr-Lys-Pro-Gln-His-His | Met(O)-Thr-Lys-Pro-Gln-His-His | 151 |
| Met(O)-Thr-Lys-Pro-Gln-Pro-His | Met(O)-Thr-Lys-Pro-Gln-Pro-His | Met(O)-Thr-Lys-Pro-Gln-Pro-His | 152 |

TABLE 1-continued

| X-OH | X-OCH₃ | X-NH₂ | SEQ ID NO |
|---|---|---|---|
| Met(O)-Thr-Lys-Pro-Gln-Lys-His | Met(O)-Thr-Lys-Pro-Gln-Lys-His | Met(O)-Thr-Lys-Pro-Gln-Lys-His | 153 |
| Met(O)-Thr-Lys-Pro-Asn-His | Met(O)-Thr-Lys-Pro-Asn-His | Met(O)-Thr-Lys-Pro-Asn-His | 154 |
| Met(O)-Thr-Lys-Pro-Asn-Arg-His | Met(O)-Thr-Lys-Pro-Asn-Arg-His | Met(O)-Thr-Lys-Pro-Asn-Arg-His | 155 |
| Met(O)-Thr-Lys-Pro-Asn-Phe-His | Met(O)-Thr-Lys-Pro-Asn-Phe-His | Met(O)-Thr-Lys-Pro-Asn-Phe-His | 156 |
| Met(O)-Thr-Lys-Pro-Asn-Tyr-His | Met(O)-Thr-Lys-Pro-Asn-Tyr-His | Met(O)-Thr-Lys-Pro-Asn-Tyr-His | 157 |
| Met(O)-Thr-Lys-Pro-Asn-His-His | Met(O)-Thr-Lys-Pro-Asn-His-His | Met(O)-Thr-Lys-Pro-Asn-His-His | 158 |
| Met(O)-Thr-Lys-Pro-Asn-Pro-His | Met(O)-Thr-Lys-Pro-Asn-Pro-His | Met(O)-Thr-Lys-Pro-Asn-Pro-His | 159 |
| Met(O)-Thr-Lys-Pro-Asn-Lys-His | Met(O)-Thr-Lys-Pro-Asn-Lys-His | Met(O)-Thr-Lys-Pro-Asn-Lys-His | 160 |
| Met(O)-Thr-Lys-Pro-Tyr-His | Met(O)-Thr-Lys-Pro-Tyr-His | Met(O)-Thr-Lys-Pro-Tyr-His | 161 |
| Met(O)-Thr-Lys-Pro-Tyr-Arg-His | Met(O)-Thr-Lys-Pro-Tyr-Arg-His | Met(O)-Thr-Lys-Pro-Tyr-Arg-His | 162 |
| Met(O)-Thr-Lys-Pro-Tyr-Phe-His | Met(O)-Thr-Lys-Pro-Tyr-Phe-His | Met(O)-Thr-Lys-Pro-Tyr-Phe-His | 163 |
| Met(O)-Thr-Lys-Pro-Tyr-Tyr-His | Met(O)-Thr-Lys-Pro-Tyr-Tyr-His | Met(O)-Thr-Lys-Pro-Tyr-Tyr-His | 164 |
| Met(O)-Thr-Lys-Pro-Tyr-His-His | Met(O)-Thr-Lys-Pro-Tyr-His-His | Met(O)-Thr-Lys-Pro-Tyr-His-His | 165 |
| Met(O)-Thr-Lys-Pro-Tyr-Pro-His | Met(O)-Thr-Lys-Pro-Tyr-Pro-His | Met(O)-Thr-Lys-Pro-Tyr-Pro-His | 166 |
| Met(O)-Thr-Lys-Pro-Tyr-Lys-His | Met(O)-Thr-Lys-Pro-Tyr-Lys-His | Met(O)-Thr-Lys-Pro-Tyr-Lys-His | 167 |
| Met(O)-Thr-Lys-Pro-Arg-His | Met(O)-Thr-Lys-Pro-Arg-His | Met(O)-Thr-Lys-Pro-Arg-His | 168 |
| Met(O)-Thr-Lys-Pro-Arg-Arg-His | Met(O)-Thr-Lys-Pro-Arg-Arg-His | Met(O)-Thr-Lys-Pro-Arg-Arg-His | 169 |
| Met(O)-Thr-Lys-Pro-Arg-Phe-His | Met(O)-Thr-Lys-Pro-Arg-Phe-His | Met(O)-Thr-Lys-Pro-Arg-Phe-His | 170 |
| Met(O)-Thr-Lys-Pro-Arg-Tyr-His | Met(O)-Thr-Lys-Pro-Arg-Tyr-His | Met(O)-Thr-Lys-Pro-Arg-Tyr-His | 171 |
| Met(O)-Thr-Lys-Pro-Arg-His-His | Met(O)-Thr-Lys-Pro-Arg-His-His | Met(O)-Thr-Lys-Pro-Arg-His-His | 172 |
| Met(O)-Thr-Lys-Pro-Arg-Pro-His | Met(O)-Thr-Lys-Pro-Arg-Pro-His | Met(O)-Thr-Lys-Pro-Arg-Pro-His | 173 |
| Met(O)-Thr-Lys-Pro-Arg-Lys-His | Met(O)-Thr-Lys-Pro-Arg-Lys-His | Met(O)-Thr-Lys-Pro-Arg-Lys-His | 174 |
| Thr-Thr-Lys-Pro-His | Thr-Thr-Lys-Pro-His | Thr-Thr-Lys-Pro-His | 175 |
| Thr-Thr-Lys-Pro-Arg-His | Thr-Thr-Lys-Pro-Arg-His | Thr-Thr-Lys-Pro-Arg-His | 176 |
| Thr-Thr-Lys-Pro-Phe-His | Thr-Thr-Lys-Pro-Phe-His | Thr-Thr-Lys-Pro-Phe-His | 177 |
| Thr-Thr-Lys-Pro-Tyr-His | Thr-Thr-Lys-Pro-Tyr-His | Thr-Thr-Lys-Pro-Tyr-His | 178 |
| Thr-Thr-Lys-Pro-Gly-His | Thr-Thr-Lys-Pro-Gly-His | Thr-Thr-Lys-Pro-Gly-His | 179 |
| Thr-Thr-Lys-Pro-His-His | Thr-Thr-Lys-Pro-His-His | Thr-Thr-Lys-Pro-His-His | 180 |

TABLE 1-continued

| X-OH | X-OCH₃ | X-NH₂ | SEQ ID NO |
|---|---|---|---|
| Thr-Thr-Lys-Pro-Lys-His | Thr-Thr-Lys-Pro-Lys-His | Thr-Thr-Lys-Pro-Lys-His | 181 |
| Thr-Thr-Lys-Pro-Gly-His | Thr-Thr-Lys-Pro-Gly-His | Thr-Thr-Lys-Pro-Gly-His | 182 |
| Thr-Thr-Lys-Pro-Gly-Arg-His | Thr-Thr-Lys-Pro-Gly-Arg-His | Thr-Thr-Lys-Pro-Gly-Arg-His | 183 |
| Thr-Thr-Lys-Pro-Gly-Phe-His | Thr-Thr-Lys-Pro-Gly-Phe-His | Thr-Thr-Lys-Pro-Gly-Phe-His | 184 |
| Thr-Thr-Lys-Pro-Gly-Tyr-His | Thr-Thr-Lys-Pro-Gly-Tyr-His | Thr-Thr-Lys-Pro-Gly-Tyr-His | 185 |
| Thr-Thr-Lys-Pro-Gly-His-His | Thr-Thr-Lys-Pro-Gly-His-His | Thr-Thr-Lys-Pro-Gly-His-His | 186 |
| Thr-Thr-Lys-Pro-Gly-Pro-His | Thr-Thr-Lys-Pro-Gly-Pro-His | Thr-Thr-Lys-Pro-Gly-Pro-His | 187 |
| Thr-Thr-Lys-Pro-Gly-Lys-His | Thr-Thr-Lys-Pro-Gly-Lys-His | Thr-Thr-Lys-Pro-Gly-Lys-His | 188 |
| Thr-Thr-Lys-Pro-Asp-His | Thr-Thr-Lys-Pro-Asp-His | Thr-Thr-Lys-Pro-Asp-His | 189 |
| Thr-Thr-Lys-Pro-Asp-Arg-His | Thr-Thr-Lys-Pro-Asp-Arg-His | Thr-Thr-Lys-Pro-Asp-Arg-His | 190 |
| Thr-Thr-Lys-Pro-Asp-Phe-His | Thr-Thr-Lys-Pro-Asp-Phe-His | Thr-Thr-Lys-Pro-Asp-Phe-His | 191 |
| Thr-Thr-Lys-Pro-Asp-Tyr-His | Thr-Thr-Lys-Pro-Asp-Tyr-His | Thr-Thr-Lys-Pro-Asp-Tyr-His | 192 |
| Thr-Thr-Lys-Pro-Asp-His-His | Thr-Thr-Lys-Pro-Asp-His-His | Thr-Thr-Lys-Pro-Asp-His-His | 193 |
| Thr-Thr-Lys-Pro-Asp-Pro-His | Thr-Thr-Lys-Pro-Asp-Pro-His | Thr-Thr-Lys-Pro-Asp-Pro-His | 194 |
| Thr-Thr-Lys-Pro-Asp-Lys-His | Thr-Thr-Lys-Pro-Asp-Lys-His | Thr-Thr-Lys-Pro-Asp-Lys-His | 195 |
| Thr-Thr-Lys-Pro-Trp-His | Thr-Thr-Lys-Pro-Trp-His | Thr-Thr-Lys-Pro-Trp-His | 196 |
| Thr-Thr-Lys-Pro-Trp-Arg-His | Thr-Thr-Lys-Pro-Trp-Arg-His | Thr-Thr-Lys-Pro-Trp-Arg-His | 197 |
| Thr-Thr-Lys-Pro-Trp-Phe-His | Thr-Thr-Lys-Pro-Trp-Phe-His | Thr-Thr-Lys-Pro-Trp-Phe-His | 198 |
| Thr-Thr-Lys-Pro-Trp-Tyr-His | Thr-Thr-Lys-Pro-Trp-Tyr-His | Thr-Thr-Lys-Pro-Trp-Tyr-His | 199 |
| Thr-Thr-Lys-Pro-Trp-His-His | Thr-Thr-Lys-Pro-Trp-His-His | Thr-Thr-Lys-Pro-Trp-His-His | 200 |
| Thr-Thr-Lys-Pro-Trp-Pro-His | Thr-Thr-Lys-Pro-Trp-Pro-His | Thr-Thr-Lys-Pro-Trp-Pro-His | 201 |
| Thr-Thr-Lys-Pro-Trp-Lys-His | Thr-Thr-Lys-Pro-Trp-Lys-His | Thr-Thr-Lys-Pro-Trp-Lys-His | 202 |
| Thr-Thr-Lys-Pro-Gln-His | Thr-Thr-Lys-Pro-Gln-His | Thr-Thr-Lys-Pro-Gln-His | 203 |
| Thr-Thr-Lys-Pro-Gln-Arg-His | Thr-Thr-Lys-Pro-Gln-Arg-His | Thr-Thr-Lys-Pro-Gln-Arg-His | 204 |
| Thr-Thr-Lys-Pro-Gln-Phe-His | Thr-Thr-Lys-Pro-Gln-Phe-His | Thr-Thr-Lys-Pro-Gln-Phe-His | 205 |
| Thr-Thr-Lys-Pro-Gln-Tyr-His | Thr-Thr-Lys-Pro-Gln-Tyr-His | Thr-Thr-Lys-Pro-Gln-Tyr-His | 206 |
| Thr-Thr-Lys-Pro-Gln-His-His | Thr-Thr-Lys-Pro-Gln-His-His | Thr-Thr-Lys-Pro-Gln-His-His | 207 |
| Thr-Thr-Lys-Pro-Gln-Pro-His | Thr-Thr-Lys-Pro-Gln-Pro-His | Thr-Thr-Lys-Pro-Gln-Pro-His | 208 |
| Thr-Thr-Lys-Pro-Gln-Lys-His | Thr-Thr-Lys-Pro-Gln-Lys-His | Thr-Thr-Lys-Pro-Gln-Lys-His | 209 |
| Thr-Thr-Lys-Pro-Asn-His | Thr-Thr-Lys-Pro-Asn-His | Thr-Thr-Lys-Pro-Asn-His | 210 |
| Thr-Thr-Lys-Pro-Asn-Arg-His | Thr-Thr-Lys-Pro-Asn-Arg-His | Thr-Thr-Lys-Pro-Asn-Arg-His | 211 |
| Thr-Thr-Lys-Pro-Asn-Phe-His | Thr-Thr-Lys-Pro-Asn-Phe-His | Thr-Thr-Lys-Pro-Asn-Phe-His | 212 |
| Thr-Thr-Lys-Pro-Asn-Tyr-His | Thr-Thr-Lys-Pro-Asn-Tyr-His | Thr-Thr-Lys-Pro-Asn-Tyr-His | 213 |
| Thr-Thr-Lys-Pro-Asn-His-His | Thr-Thr-Lys-Pro-Asn-His-His | Thr-Thr-Lys-Pro-Asn-His-His | 214 |
| Thr-Thr-Lys-Pro-Asn-Pro-His | Thr-Thr-Lys-Pro-Asn-Pro-His | Thr-Thr-Lys-Pro-Asn-Pro-His | 215 |
| Thr-Thr-Lys-Pro-Asn-Lys-His | Thr-Thr-Lys-Pro-Asn-Lys-His | Thr-Thr-Lys-Pro-Asn-Lys-His | 216 |
| Thr-Thr-Lys-Pro-Tyr-His | Thr-Thr-Lys-Pro-Tyr-His | Thr-Thr-Lys-Pro-Tyr-His | 217 |
| Thr-Thr-Lys-Pro-Tyr-Arg-His | Thr-Thr-Lys-Pro-Tyr-Arg-His | Thr-Thr-Lys-Pro-Tyr-Arg-His | 218 |

TABLE 1-continued

| X-OH | X-OCH₃ | X-NH₂ | SEQ ID NO |
|---|---|---|---|
| Thr-Thr-Lys-Pro-Tyr-Phe-His | Thr-Thr-Lys-Pro-Tyr-Phe-His | Thr-Thr-Lys-Pro-Tyr-Phe-His | 219 |
| Thr-Thr-Lys-Pro-Tyr-Tyr-His | Thr-Thr-Lys-Pro-Tyr-Tyr-His | Thr-Thr-Lys-Pro-Tyr-Tyr-His | 220 |
| Thr-Thr-Lys-Pro-Tyr-His-His | Thr-Thr-Lys-Pro-Tyr-His-His | Thr-Thr-Lys-Pro-Tyr-His-His | 221 |
| Thr-Thr-Lys-Pro-Tyr-Pro-His | Thr-Thr-Lys-Pro-Tyr-Pro-His | Thr-Thr-Lys-Pro-Tyr-Pro-His | 222 |
| Thr-Thr-Lys-Pro-Tyr-Lys-His | Thr-Thr-Lys-Pro-Tyr-Lys-His | Thr-Thr-Lys-Pro-Tyr-Lys-His | 223 |
| Thr-Thr-Lys-Pro-Arg-His | Thr-Thr-Lys-Pro-Arg-His | Thr-Thr-Lys-Pro-Arg-His | 224 |
| Thr-Thr-Lys-Pro-Arg-Arg-His | Thr-Thr-Lys-Pro-Arg-Arg-His | Thr-Thr-Lys-Pro-Arg-Arg-His | 225 |
| Thr-Thr-Lys-Pro-Arg-Phe-His | Thr-Thr-Lys-Pro-Arg-Phe-His | Thr-Thr-Lys-Pro-Arg-Phe-His | 226 |
| Thr-Thr-Lys-Pro-Arg-Tyr-His | Thr-Thr-Lys-Pro-Arg-Tyr-His | Thr-Thr-Lys-Pro-Arg-Tyr-His | 227 |
| Thr-Thr-Lys-Pro-Arg-His-His | Thr-Thr-Lys-Pro-Arg-His-His | Thr-Thr-Lys-Pro-Arg-His-His | 228 |
| Thr-Thr-Lys-Pro-Arg-Pro-His | Thr-Thr-Lys-Pro-Arg-Pro-His | Thr-Thr-Lys-Pro-Arg-Pro-His | 229 |
| Thr-Thr-Lys-Pro-Arg-Lys-His | Thr-Thr-Lys-Pro-Arg-Lys-His | Thr-Thr-Lys-Pro-Arg-Lys-His | 230 |
| Ala-Thr-Lys-Pro-His | Ala-Thr-Lys-Pro-His | Ala-Thr-Lys-Pro-His | 231 |
| Ala-Thr-Lys-Pro-Arg-His | Ala-Thr-Lys-Pro-Arg-His | Ala-Thr-Lys-Pro-Arg-His | 232 |
| Ala-Thr-Lys-Pro-Phe-His | Ala-Thr-Lys-Pro-Phe-His | Ala-Thr-Lys-Pro-Phe-His | 233 |
| Ala-Thr-Lys-Pro-Tyr-His | Ala-Thr-Lys-Pro-Tyr-His | Ala-Thr-Lys-Pro-Tyr-His | 234 |
| Ala-Thr-Lys-Pro-Gly-His | Ala-Thr-Lys-Pro-Gly-His | Ala-Thr-Lys-Pro-Gly-His | 235 |
| Ala-Thr-Lys-Pro-His-His | Ala-Thr-Lys-Pro-His-His | Ala-Thr-Lys-Pro-His-His | 236 |
| Ala-Thr-Lys-Pro-Lys-His | Ala-Thr-Lys-Pro-Lys-His | Ala-Thr-Lys-Pro-Lys-His | 237 |
| Ala-Thr-Lys-Pro-Gly-His | Ala-Thr-Lys-Pro-Gly-His | Ala-Thr-Lys-Pro-Gly-His | 238 |
| Ala-Thr-Lys-Pro-Gly-Arg-His | Ala-Thr-Lys-Pro-Gly-Arg-His | Ala-Thr-Lys-Pro-Gly-Arg-His | 239 |
| Ala-Thr-Lys-Pro-Gly-Phe-His | Ala-Thr-Lys-Pro-Gly-Phe-His | Ala-Thr-Lys-Pro-Gly-Phe-His | 240 |
| Ala-Thr-Lys-Pro-Gly-Tyr-His | Ala-Thr-Lys-Pro-Gly-Tyr-His | Ala-Thr-Lys-Pro-Gly-Tyr-His | 241 |
| Ala-Thr-Lys-Pro-Gly-His-His | Ala-Thr-Lys-Pro-Gly-His-His | Ala-Thr-Lys-Pro-Gly-His-His | 242 |
| Ala-Thr-Lys-Pro-Gly-Pro-His | Ala-Thr-Lys-Pro-Gly-Pro-His | Ala-Thr-Lys-Pro-Gly-Pro-His | 243 |
| Ala-Thr-Lys-Pro-Gly-Lys-His | Ala-Thr-Lys-Pro-Gly-Lys-His | Ala-Thr-Lys-Pro-Gly-Lys-His | 244 |
| Ala-Thr-Lys-Pro-Asp-His | Ala-Thr-Lys-Pro-Asp-His | Ala-Thr-Lys-Pro-Asp-His | 245 |
| Ala-Thr-Lys-Pro-Asp-Arg-His | Ala-Thr-Lys-Pro-Asp-Arg-His | Ala-Thr-Lys-Pro-Asp-Arg-His | 246 |
| Ala-Thr-Lys-Pro-Asp-Phe-His | Ala-Thr-Lys-Pro-Asp-Phe-His | Ala-Thr-Lys-Pro-Asp-Phe-His | 247 |
| Ala-Thr-Lys-Pro-Asp-Tyr-His | Ala-Thr-Lys-Pro-Asp-Tyr-His | Ala-Thr-Lys-Pro-Asp-Tyr-His | 248 |
| Ala-Thr-Lys-Pro-Asp-His-His | Ala-Thr-Lys-Pro-Asp-His-His | Ala-Thr-Lys-Pro-Asp-His-His | 249 |
| Ala-Thr-Lys-Pro-Asp-Pro-His | Ala-Thr-Lys-Pro-Asp-Pro-His | Ala-Thr-Lys-Pro-Asp-Pro-His | 250 |
| Ala-Thr-Lys-Pro-Asp-Lys-His | Ala-Thr-Lys-Pro-Asp-Lys-His | Ala-Thr-Lys-Pro-Asp-Lys-His | 251 |
| Ala-Thr-Lys-Pro-Trp-His | Ala-Thr-Lys-Pro-Trp-His | Ala-Thr-Lys-Pro-Trp-His | 252 |
| Ala-Thr-Lys-Pro-Trp-Arg-His | Ala-Thr-Lys-Pro-Trp-Arg-His | Ala-Thr-Lys-Pro-Trp-Arg-His | 253 |
| Ala-Thr-Lys-Pro-Trp-Phe-His | Ala-Thr-Lys-Pro-Trp-Phe-His | Ala-Thr-Lys-Pro-Trp-Phe-His | 254 |
| Ala-Thr-Lys-Pro-Trp-Tyr-His | Ala-Thr-Lys-Pro-Trp-Tyr-His | Ala-Thr-Lys-Pro-Trp-Tyr-His | 255 |
| Ala-Thr-Lys-Pro-Trp-His-His | Ala-Thr-Lys-Pro-Trp-His-His | Ala-Thr-Lys-Pro-Trp-His-His | 256 |

TABLE 1-continued

| X-OH | X-OCH₃ | X-NH₂ | SEQ ID NO |
|---|---|---|---|
| Ala-Thr-Lys-Pro-Trp-Pro-His | Ala-Thr-Lys-Pro-Trp-Pro-His | Ala-Thr-Lys-Pro-Trp-Pro-His | 257 |
| Ala-Thr-Lys-Pro-Trp-Lys-His | Ala-Thr-Lys-Pro-Trp-Lys-His | Ala-Thr-Lys-Pro-Trp-Lys-His | 258 |
| Ala-Thr-Lys-Pro-Gln-His | Ala-Thr-Lys-Pro-Gln-His | Ala-Thr-Lys-Pro-Gln-His | 259 |
| Ala-Thr-Lys-Pro-Gln-Arg-His | Ala-Thr-Lys-Pro-Gln-Arg-His | Ala-Thr-Lys-Pro-Gln-Arg-His | 260 |
| Ala-Thr-Lys-Pro-Gln-Phe-His | Ala-Thr-Lys-Pro-Gln-Phe-His | Ala-Thr-Lys-Pro-Gln-Phe-His | 261 |
| Ala-Thr-Lys-Pro-Gln-Tyr-His | Ala-Thr-Lys-Pro-Gln-Tyr-His | Ala-Thr-Lys-Pro-Gln-Tyr-His | 262 |
| Ala-Thr-Lys-Pro-Gln-His-His | Ala-Thr-Lys-Pro-Gln-His-His | Ala-Thr-Lys-Pro-Gln-His-His | 263 |
| Ala-Thr-Lys-Pro-Gln-Pro-His | Ala-Thr-Lys-Pro-Gln-Pro-His | Ala-Thr-Lys-Pro-Gln-Pro-His | 264 |
| Ala-Thr-Lys-Pro-Gln-Lys-His | Ala-Thr-Lys-Pro-Gln-Lys-His | Ala-Thr-Lys-Pro-Gln-Lys-His | 265 |
| Ala-Thr-Lys-Pro-Asn-His | Ala-Thr-Lys-Pro-Asn-His | Ala-Thr-Lys-Pro-Asn-His | 266 |
| Ala-Thr-Lys-Pro-Asn-Arg-His | Ala-Thr-Lys-Pro-Asn-Arg-His | Ala-Thr-Lys-Pro-Asn-Arg-His | 267 |
| Ala-Thr-Lys-Pro-Asn-Phe-His | Ala-Thr-Lys-Pro-Asn-Phe-His | Ala-Thr-Lys-Pro-Asn-Phe-His | 268 |
| Ala-Thr-Lys-Pro-Asn-Tyr-His | Ala-Thr-Lys-Pro-Asn-Tyr-His | Ala-Thr-Lys-Pro-Asn-Tyr-His | 269 |
| Ala-Thr-Lys-Pro-Asn-His-His | Ala-Thr-Lys-Pro-Asn-His-His | Ala-Thr-Lys-Pro-Asn-His-His | 270 |
| Ala-Thr-Lys-Pro-Asn-Pro-His | Ala-Thr-Lys-Pro-Asn-Pro-His | Ala-Thr-Lys-Pro-Asn-Pro-His | 271 |
| Ala-Thr-Lys-Pro-Asn-Lys-His | Ala-Thr-Lys-Pro-Asn-Lys-His | Ala-Thr-Lys-Pro-Asn-Lys-His | 272 |
| Ala-Thr-Lys-Pro-Tyr-His | Ala-Thr-Lys-Pro-Tyr-His | Ala-Thr-Lys-Pro-Tyr-His | 273 |
| Ala-Thr-Lys-Pro-Tyr-Arg-His | Ala-Thr-Lys-Pro-Tyr-Arg-His | Ala-Thr-Lys-Pro-Tyr-Arg-His | 274 |
| Ala-Thr-Lys-Pro-Tyr-Phe-His | Ala-Thr-Lys-Pro-Tyr-Phe-His | Ala-Thr-Lys-Pro-Tyr-Phe-His | 275 |
| Ala-Thr-Lys-Pro-Tyr-Tyr-His | Ala-Thr-Lys-Pro-Tyr-Tyr-His | Ala-Thr-Lys-Pro-Tyr-Tyr-His | 276 |
| Ala-Thr-Lys-Pro-Tyr-His-His | Ala-Thr-Lys-Pro-Tyr-His-His | Ala-Thr-Lys-Pro-Tyr-His-His | 277 |
| Ala-Thr-Lys-Pro-Tyr-Pro-His | Ala-Thr-Lys-Pro-Tyr-Pro-His | Ala-Thr-Lys-Pro-Tyr-Pro-His | 278 |
| Ala-Thr-Lys-Pro-Tyr-Lys-His | Ala-Thr-Lys-Pro-Tyr-Lys-His | Ala-Thr-Lys-Pro-Tyr-Lys-His | 279 |
| Ala-Thr-Lys-Pro-Arg-His | Ala-Thr-Lys-Pro-Arg-His | Ala-Thr-Lys-Pro-Arg-His | 280 |
| Ala-Thr-Lys-Pro-Arg-Arg-His | Ala-Thr-Lys-Pro-Arg-Arg-His | Ala-Thr-Lys-Pro-Arg-Arg-His | 281 |
| Ala-Thr-Lys-Pro-Arg-Phe-His | Ala-Thr-Lys-Pro-Arg-Phe-His | Ala-Thr-Lys-Pro-Arg-Phe-His | 282 |
| Ala-Thr-Lys-Pro-Arg-Tyr-His | Ala-Thr-Lys-Pro-Arg-Tyr-His | Ala-Thr-Lys-Pro-Arg-Tyr-His | 283 |
| Ala-Thr-Lys-Pro-Arg-His-His | Ala-Thr-Lys-Pro-Arg-His-His | Ala-Thr-Lys-Pro-Arg-His-His | 284 |
| Ala-Thr-Lys-Pro-Arg-Pro-His | Ala-Thr-Lys-Pro-Arg-Pro-His | Ala-Thr-Lys-Pro-Arg-Pro-His | 285 |
| Ala-Thr-Lys-Pro-Arg-Lys-His | Ala-Thr-Lys-Pro-Arg-Lys-His | Ala-Thr-Lys-Pro-Arg-Lys-His | 286 |
| His-Thr-Lys-Pro-His | His-Thr-Lys-Pro-His | His-Thr-Lys-Pro-His | 287 |
| His-Thr-Lys-Pro-Arg-His | His-Thr-Lys-Pro-Arg-His | His-Thr-Lys-Pro-Arg-His | 288 |
| His-Thr-Lys-Pro-Phe-His | His-Thr-Lys-Pro-Phe-His | His-Thr-Lys-Pro-Phe-His | 289 |
| His-Thr-Lys-Pro-Tyr-His | His-Thr-Lys-Pro-Tyr-His | His-Thr-Lys-Pro-Tyr-His | 290 |
| His-Thr-Lys-Pro-Gly-His | His-Thr-Lys-Pro-Gly-His | His-Thr-Lys-Pro-Gly-His | 291 |
| His-Thr-Lys-Pro-His-His | His-Thr-Lys-Pro-His-His | His-Thr-Lys-Pro-His-His | 292 |
| His-Thr-Lys-Pro-Lys-His | His-Thr-Lys-Pro-Lys-His | His-Thr-Lys-Pro-Lys-His | 293 |
| His-Thr-Lys-Pro-Gly-His | His-Thr-Lys-Pro-Gly-His | His-Thr-Lys-Pro-Gly-His | 294 |

TABLE 1-continued

| X-OH | X-OCH₃ | X-NH₂ | SEQ ID NO |
|---|---|---|---|
| His-Thr-Lys-Pro-Gly-Arg-His | His-Thr-Lys-Pro-Gly-Arg-His | His-Thr-Lys-Pro-Gly-Arg-His | 295 |
| His-Thr-Lys-Pro-Gly-Phe-His | His-Thr-Lys-Pro-Gly-Phe-His | His-Thr-Lys-Pro-Gly-Phe-His | 296 |
| His-Thr-Lys-Pro-Gly-Tyr-His | His-Thr-Lys-Pro-Gly-Tyr-His | His-Thr-Lys-Pro-Gly-Tyr-His | 297 |
| His-Thr-Lys-Pro-Gly-His-His | His-Thr-Lys-Pro-Gly-His-His | His-Thr-Lys-Pro-Gly-His-His | 298 |
| His-Thr-Lys-Pro-Gly-Pro-His | His-Thr-Lys-Pro-Gly-Pro-His | His-Thr-Lys-Pro-Gly-Pro-His | 299 |
| His-Thr-Lys-Pro-Gly-Lys-His | His-Thr-Lys-Pro-Gly-Lys-His | His-Thr-Lys-Pro-Gly-Lys-His | 300 |
| His-Thr-Lys-Pro-Asp-His | His-Thr-Lys-Pro-Asp-His | His-Thr-Lys-Pro-Asp-His | 301 |
| His-Thr-Lys-Pro-Asp-Arg-His | His-Thr-Lys-Pro-Asp-Arg-His | His-Thr-Lys-Pro-Asp-Arg-His | 302 |
| His-Thr-Lys-Pro-Asp-Phe-His | His-Thr-Lys-Pro-Asp-Phe-His | His-Thr-Lys-Pro-Asp-Phe-His | 303 |
| His-Thr-Lys-Pro-Asp-Tyr-His | His-Thr-Lys-Pro-Asp-Tyr-His | His-Thr-Lys-Pro-Asp-Tyr-His | 304 |
| His-Thr-Lys-Pro-Asp-His-His | His-Thr-Lys-Pro-Asp-His-His | His-Thr-Lys-Pro-Asp-His-His | 305 |
| His-Thr-Lys-Pro-Asp-Pro-His | His-Thr-Lys-Pro-Asp-Pro-His | His-Thr-Lys-Pro-Asp-Pro-His | 306 |
| His-Thr-Lys-Pro-Asp-Lys-His | His-Thr-Lys-Pro-Asp-Lys-His | His-Thr-Lys-Pro-Asp-Lys-His | 307 |
| His-Thr-Lys-Pro-Trp-His | His-Thr-Lys-Pro-Trp-His | His-Thr-Lys-Pro-Trp-His | 308 |
| His-Thr-Lys-Pro-Trp-Arg-His | His-Thr-Lys-Pro-Trp-Arg-His | His-Thr-Lys-Pro-Trp-Arg-His | 309 |
| His-Thr-Lys-Pro-Trp-Phe-His | His-Thr-Lys-Pro-Trp-Phe-His | His-Thr-Lys-Pro-Trp-Phe-His | 310 |
| His-Thr-Lys-Pro-Trp-Tyr-His | His-Thr-Lys-Pro-Trp-Tyr-His | His-Thr-Lys-Pro-Trp-Tyr-His | 311 |
| His-Thr-Lys-Pro-Trp-His-His | His-Thr-Lys-Pro-Trp-His-His | His-Thr-Lys-Pro-Trp-His-His | 312 |
| His-Thr-Lys-Pro-Trp-Pro-His | His-Thr-Lys-Pro-Trp-Pro-His | His-Thr-Lys-Pro-Trp-Pro-His | 313 |
| His-Thr-Lys-Pro-Trp-Lys-His | His-Thr-Lys-Pro-Trp-Lys-His | His-Thr-Lys-Pro-Trp-Lys-His | 314 |
| His-Thr-Lys-Pro-Gln-His | His-Thr-Lys-Pro-Gln-His | His-Thr-Lys-Pro-Gln-His | 315 |
| His-Thr-Lys-Pro-Gln-Arg-His | His-Thr-Lys-Pro-Gln-Arg-His | His-Thr-Lys-Pro-Gln-Arg-His | 316 |
| His-Thr-Lys-Pro-Gln-Phe-His | His-Thr-Lys-Pro-Gln-Phe-His | His-Thr-Lys-Pro-Gln-Phe-His | 317 |
| His-Thr-Lys-Pro-Gln-Tyr-His | His-Thr-Lys-Pro-Gln-Tyr-His | His-Thr-Lys-Pro-Gln-Tyr-His | 318 |
| His-Thr-Lys-Pro-Gln-His-His | His-Thr-Lys-Pro-Gln-His-His | His-Thr-Lys-Pro-Gln-His-His | 319 |
| His-Thr-Lys-Pro-Gln-Pro-His | His-Thr-Lys-Pro-Gln-Pro-His | His-Thr-Lys-Pro-Gln-Pro-His | 320 |
| His-Thr-Lys-Pro-Gln-Lys-His | His-Thr-Lys-Pro-Gln-Lys-His | His-Thr-Lys-Pro-Gln-Lys-His | 321 |
| His-Thr-Lys-Pro-Asn-His | His-Thr-Lys-Pro-Asn-His | His-Thr-Lys-Pro-Asn-His | 322 |
| His-Thr-Lys-Pro-Asn-Arg-His | His-Thr-Lys-Pro-Asn-Arg-His | His-Thr-Lys-Pro-Asn-Arg-His | 323 |
| His-Thr-Lys-Pro-Asn-Phe-His | His-Thr-Lys-Pro-Asn-Phe-His | His-Thr-Lys-Pro-Asn-Phe-His | 324 |
| His-Thr-Lys-Pro-Asn-Tyr-His | His-Thr-Lys-Pro-Asn-Tyr-His | His-Thr-Lys-Pro-Asn-Tyr-His | 325 |
| His-Thr-Lys-Pro-Asn-His-His | His-Thr-Lys-Pro-Asn-His-His | His-Thr-Lys-Pro-Asn-His-His | 326 |
| His-Thr-Lys-Pro-Asn-Pro-His | His-Thr-Lys-Pro-Asn-Pro-His | His-Thr-Lys-Pro-Asn-Pro-His | 327 |
| His-Thr-Lys-Pro-Asn-Lys-His | His-Thr-Lys-Pro-Asn-Lys-His | His-Thr-Lys-Pro-Asn-Lys-His | 328 |
| His-Thr-Lys-Pro-Tyr-His | His-Thr-Lys-Pro-Tyr-His | His-Thr-Lys-Pro-Tyr-His | 329 |
| His-Thr-Lys-Pro-Tyr-Arg-His | His-Thr-Lys-Pro-Tyr-Arg-His | His-Thr-Lys-Pro-Tyr-Arg-His | 330 |
| His-Thr-Lys-Pro-Tyr-Phe-His | His-Thr-Lys-Pro-Tyr-Phe-His | His-Thr-Lys-Pro-Tyr-Phe-His | 331 |
| His-Thr-Lys-Pro-Tyr-Tyr-His | His-Thr-Lys-Pro-Tyr-Tyr-His | His-Thr-Lys-Pro-Tyr-Tyr-His | 332 |

TABLE 1-continued

| X-OH | X-OCH₃ | X-NH₂ | SEQ ID NO |
|---|---|---|---|
| His-Thr-Lys-Pro-Tyr-His-His | His-Thr-Lys-Pro-Tyr-His-His | His-Thr-Lys-Pro-Tyr-His-His | 333 |
| His-Thr-Lys-Pro-Tyr-Pro-His | His-Thr-Lys-Pro-Tyr-Pro-His | His-Thr-Lys-Pro-Tyr-Pro-His | 334 |
| His-Thr-Lys-Pro-Tyr-Lys-His | His-Thr-Lys-Pro-Tyr-Lys-His | His-Thr-Lys-Pro-Tyr-Lys-His | 335 |
| His-Thr-Lys-Pro-Arg-His | His-Thr-Lys-Pro-Arg-His | His-Thr-Lys-Pro-Arg-His | 336 |
| His-Thr-Lys-Pro-Arg-Arg-His | His-Thr-Lys-Pro-Arg-Arg-His | His-Thr-Lys-Pro-Arg-Arg-His | 337 |
| His-Thr-Lys-Pro-Arg-Phe-His | His-Thr-Lys-Pro-Arg-Phe-His | His-Thr-Lys-Pro-Arg-Phe-His | 338 |
| His-Thr-Lys-Pro-Arg-Tyr-His | His-Thr-Lys-Pro-Arg-Tyr-His | His-Thr-Lys-Pro-Arg-Tyr-His | 339 |
| His-Thr-Lys-Pro-Arg-His-His | His-Thr-Lys-Pro-Arg-His-His | His-Thr-Lys-Pro-Arg-His-His | 340 |
| His-Thr-Lys-Pro-Arg-Pro-His | His-Thr-Lys-Pro-Arg-Pro-His | His-Thr-Lys-Pro-Arg-Pro-His | 341 |
| His-Thr-Lys-Pro-Arg-Lys-His | His-Thr-Lys-Pro-Arg-Lys-His | His-Thr-Lys-Pro-Arg-Lys-His | 342 |
| Lys-Thr-Lys-Pro-His | Lys-Thr-Lys-Pro-His | Lys-Thr-Lys-Pro-His | 343 |
| Lys-Thr-Lys-Pro-Arg-His | Lys-Thr-Lys-Pro-Arg-His | Lys-Thr-Lys-Pro-Arg-His | 344 |
| Lys-Thr-Lys-Pro-Phe-His | Lys-Thr-Lys-Pro-Phe-His | Lys-Thr-Lys-Pro-Phe-His | 345 |
| Lys-Thr-Lys-Pro-Tyr-His | Lys-Thr-Lys-Pro-Tyr-His | Lys-Thr-Lys-Pro-Tyr-His | 346 |
| Lys-Thr-Lys-Pro-Gly-His | Lys-Thr-Lys-Pro-Gly-His | Lys-Thr-Lys-Pro-Gly-His | 347 |
| Lys-Thr-Lys-Pro-His-His | Lys-Thr-Lys-Pro-His-His | Lys-Thr-Lys-Pro-His-His | 348 |
| Lys-Thr-Lys-Pro-Lys-His | Lys-Thr-Lys-Pro-Lys-His | Lys-Thr-Lys-Pro-Lys-His | 349 |
| Lys-Thr-Lys-Pro-Gly-His | Lys-Thr-Lys-Pro-Gly-His | Lys-Thr-Lys-Pro-Gly-His | 350 |
| Lys-Thr-Lys-Pro-Gly-Arg-His | Lys-Thr-Lys-Pro-Gly-Arg-His | Lys-Thr-Lys-Pro-Gly-Arg-His | 351 |
| Lys-Thr-Lys-Pro-Gly-Phe-His | Lys-Thr-Lys-Pro-Gly-Phe-His | Lys-Thr-Lys-Pro-Gly-Phe-His | 352 |
| Lys-Thr-Lys-Pro-Gly-Tyr-His | Lys-Thr-Lys-Pro-Gly-Tyr-His | Lys-Thr-Lys-Pro-Gly-Tyr-His | 353 |
| Lys-Thr-Lys-Pro-Gly-His-His | Lys-Thr-Lys-Pro-Gly-His-His | Lys-Thr-Lys-Pro-Gly-His-His | 354 |
| Lys-Thr-Lys-Pro-Gly-Pro-His | Lys-Thr-Lys-Pro-Gly-Pro-His | Lys-Thr-Lys-Pro-Gly-Pro-His | 355 |
| Lys-Thr-Lys-Pro-Gly-Lys-His | Lys-Thr-Lys-Pro-Gly-Lys-His | Lys-Thr-Lys-Pro-Gly-Lys-His | 356 |
| Lys-Thr-Lys-Pro-Asp-His | Lys-Thr-Lys-Pro-Asp-His | Lys-Thr-Lys-Pro-Asp-His | 357 |
| Lys-Thr-Lys-Pro-Asp-Arg-His | Lys-Thr-Lys-Pro-Asp-Arg-His | Lys-Thr-Lys-Pro-Asp-Arg-His | 358 |
| Lys-Thr-Lys-Pro-Asp-Phe-His | Lys-Thr-Lys-Pro-Asp-Phe-His | Lys-Thr-Lys-Pro-Asp-Phe-His | 359 |
| Lys-Thr-Lys-Pro-Asp-Tyr-His | Lys-Thr-Lys-Pro-Asp-Tyr-His | Lys-Thr-Lys-Pro-Asp-Tyr-His | 360 |
| Lys-Thr-Lys-Pro-Asp-His-His | Lys-Thr-Lys-Pro-Asp-His-His | Lys-Thr-Lys-Pro-Asp-His-His | 361 |
| Lys-Thr-Lys-Pro-Asp-Pro-His | Lys-Thr-Lys-Pro-Asp-Pro-His | Lys-Thr-Lys-Pro-Asp-Pro-His | 362 |
| Lys-Thr-Lys-Pro-Asp-Lys-His | Lys-Thr-Lys-Pro-Asp-Lys-His | Lys-Thr-Lys-Pro-Asp-Lys-His | 363 |
| Lys-Thr-Lys-Pro-Trp-His | Lys-Thr-Lys-Pro-Trp-His | Lys-Thr-Lys-Pro-Trp-His | 364 |
| Lys-Thr-Lys-Pro-Trp-Arg-His | Lys-Thr-Lys-Pro-Trp-Arg-His | Lys-Thr-Lys-Pro-Trp-Arg-His | 365 |
| Lys-Thr-Lys-Pro-Trp-Phe-His | Lys-Thr-Lys-Pro-Trp-Phe-His | Lys-Thr-Lys-Pro-Trp-Phe-His | 366 |
| Lys-Thr-Lys-Pro-Trp-Tyr-His | Lys-Thr-Lys-Pro-Trp-Tyr-His | Lys-Thr-Lys-Pro-Trp-Tyr-His | 367 |
| Lys-Thr-Lys-Pro-Trp-His-His | Lys-Thr-Lys-Pro-Trp-His-His | Lys-Thr-Lys-Pro-Trp-His-His | 368 |
| Lys-Thr-Lys-Pro-Trp-Pro-His | Lys-Thr-Lys-Pro-Trp-Pro-His | Lys-Thr-Lys-Pro-Trp-Pro-His | 369 |
| Lys-Thr-Lys-Pro-Trp-Lys-His | Lys-Thr-Lys-Pro-Trp-Lys-His | Lys-Thr-Lys-Pro-Trp-Lys-His | 370 |

TABLE 1-continued

| X-OH | X-OCH₃ | X-NH₂ | SEQ ID NO |
|---|---|---|---|
| Lys-Thr-Lys-Pro-Gln-His | Lys-Thr-Lys-Pro-Gln-His | Lys-Thr-Lys-Pro-Gln-His | 371 |
| Lys-Thr-Lys-Pro-Gln-Arg-His | Lys-Thr-Lys-Pro-Gln-Arg-His | Lys-Thr-Lys-Pro-Gln-Arg-His | 372 |
| Lys-Thr-Lys-Pro-Gln-Phe-His | Lys-Thr-Lys-Pro-Gln-Phe-His | Lys-Thr-Lys-Pro-Gln-Phe-His | 373 |
| Lys-Thr-Lys-Pro-Gln-Tyr-His | Lys-Thr-Lys-Pro-Gln-Tyr-His | Lys-Thr-Lys-Pro-Gln-Tyr-His | 374 |
| Lys-Thr-Lys-Pro-Gln-His-His | Lys-Thr-Lys-Pro-Gln-His-His | Lys-Thr-Lys-Pro-Gln-His-His | 375 |
| Lys-Thr-Lys-Pro-Gln-Pro-His | Lys-Thr-Lys-Pro-Gln-Pro-His | Lys-Thr-Lys-Pro-Gln-Pro-His | 376 |
| Lys-Thr-Lys-Pro-Gln-Lys-His | Lys-Thr-Lys-Pro-Gln-Lys-His | Lys-Thr-Lys-Pro-Gln-Lys-His | 377 |
| Lys-Thr-Lys-Pro-Asn-His | Lys-Thr-Lys-Pro-Asn-His | Lys-Thr-Lys-Pro-Asn-His | 378 |
| Lys-Thr-Lys-Pro-Asn-Arg-His | Lys-Thr-Lys-Pro-Asn-Arg-His | Lys-Thr-Lys-Pro-Asn-Arg-His | 379 |
| Lys-Thr-Lys-Pro-Asn-Phe-His | Lys-Thr-Lys-Pro-Asn-Phe-His | Lys-Thr-Lys-Pro-Asn-Phe-His | 380 |
| Lys-Thr-Lys-Pro-Asn-Tyr-His | Lys-Thr-Lys-Pro-Asn-Tyr-His | Lys-Thr-Lys-Pro-Asn-Tyr-His | 381 |
| Lys-Thr-Lys-Pro-Asn-His-His | Lys-Thr-Lys-Pro-Asn-His-His | Lys-Thr-Lys-Pro-Asn-His-His | 382 |
| Lys-Thr-Lys-Pro-Asn-Pro-His | Lys-Thr-Lys-Pro-Asn-Pro-His | Lys-Thr-Lys-Pro-Asn-Pro-His | 383 |
| Lys-Thr-Lys-Pro-Asn-Lys-His | Lys-Thr-Lys-Pro-Asn-Lys-His | Lys-Thr-Lys-Pro-Asn-Lys-His | 384 |
| Lys-Thr-Lys-Pro-Tyr-His | Lys-Thr-Lys-Pro-Tyr-His | Lys-Thr-Lys-Pro-Tyr-His | 385 |
| Lys-Thr-Lys-Pro-Tyr-Arg-His | Lys-Thr-Lys-Pro-Tyr-Arg-His | Lys-Thr-Lys-Pro-Tyr-Arg-His | 386 |
| Lys-Thr-Lys-Pro-Tyr-Phe-His | Lys-Thr-Lys-Pro-Tyr-Phe-His | Lys-Thr-Lys-Pro-Tyr-Phe-His | 387 |
| Lys-Thr-Lys-Pro-Tyr-Tyr-His | Lys-Thr-Lys-Pro-Tyr-Tyr-His | Lys-Thr-Lys-Pro-Tyr-Tyr-His | 388 |
| Lys-Thr-Lys-Pro-Tyr-His-His | Lys-Thr-Lys-Pro-Tyr-His-His | Lys-Thr-Lys-Pro-Tyr-His-His | 389 |
| Lys-Thr-Lys-Pro-Tyr-Pro-His | Lys-Thr-Lys-Pro-Tyr-Pro-His | Lys-Thr-Lys-Pro-Tyr-Pro-His | 390 |
| Lys-Thr-Lys-Pro-Tyr-Lys-His | Lys-Thr-Lys-Pro-Tyr-Lys-His | Lys-Thr-Lys-Pro-Tyr-Lys-His | 391 |
| Lys-Thr-Lys-Pro-Arg-His | Lys-Thr-Lys-Pro-Arg-His | Lys-Thr-Lys-Pro-Arg-His | 392 |
| Lys-Thr-Lys-Pro-Arg-Arg-His | Lys-Thr-Lys-Pro-Arg-Arg-His | Lys-Thr-Lys-Pro-Arg-Arg-His | 393 |
| Lys-Thr-Lys-Pro-Arg-Phe-His | Lys-Thr-Lys-Pro-Arg-Phe-His | Lys-Thr-Lys-Pro-Arg-Phe-His | 394 |
| Lys-Thr-Lys-Pro-Arg-Tyr-His | Lys-Thr-Lys-Pro-Arg-Tyr-His | Lys-Thr-Lys-Pro-Arg-Tyr-His | 395 |
| Lys-Thr-Lys-Pro-Arg-His-His | Lys-Thr-Lys-Pro-Arg-His-His | Lys-Thr-Lys-Pro-Arg-His-His | 396 |
| Lys-Thr-Lys-Pro-Arg-Pro-His | Lys-Thr-Lys-Pro-Arg-Pro-His | Lys-Thr-Lys-Pro-Arg-Pro-His | 397 |
| Lys-Thr-Lys-Pro-Arg-Lys-His | Lys-Thr-Lys-Pro-Arg-Lys-His | Lys-Thr-Lys-Pro-Arg-Lys-His | 398 |
| Gly-Thr-Lys-Pro-His | Gly-Thr-Lys-Pro-His | Gly-Thr-Lys-Pro-His | 399 |
| Gly-Thr-Lys-Pro-Arg-His | Gly-Thr-Lys-Pro-Arg-His | Gly-Thr-Lys-Pro-Arg-His | 400 |
| Gly-Thr-Lys-Pro-Phe-His | Gly-Thr-Lys-Pro-Phe-His | Gly-Thr-Lys-Pro-Phe-His | 401 |
| Gly-Thr-Lys-Pro-Tyr-His | Gly-Thr-Lys-Pro-Tyr-His | Gly-Thr-Lys-Pro-Tyr-His | 402 |
| Gly-Thr-Lys-Pro-Gly-His | Gly-Thr-Lys-Pro-Gly-His | Gly-Thr-Lys-Pro-Gly-His | 403 |
| Gly-Thr-Lys-Pro-His-His | Gly-Thr-Lys-Pro-His-His | Gly-Thr-Lys-Pro-His-His | 404 |
| Gly-Thr-Lys-Pro-Lys-His | Gly-Thr-Lys-Pro-Lys-His | Gly-Thr-Lys-Pro-Lys-His | 405 |
| Gly-Thr-Lys-Pro-Gly-His | Gly-Thr-Lys-Pro-Gly-His | Gly-Thr-Lys-Pro-Gly-His | 406 |
| Gly-Thr-Lys-Pro-Gly-Arg-His | Gly-Thr-Lys-Pro-Gly-Arg-His | Gly-Thr-Lys-Pro-Gly-Arg-His | 407 |
| Gly-Thr-Lys-Pro-Gly-Phe-His | Gly-Thr-Lys-Pro-Gly-Phe-His | Gly-Thr-Lys-Pro-Gly-Phe-His | 408 |

TABLE 1-continued

| X-OH | X-OCH₃ | X-NH₂ | SEQ ID NO |
|---|---|---|---|
| Gly-Thr-Lys-Pro-Gly-Tyr-His | Gly-Thr-Lys-Pro-Gly-Tyr-His | Gly-Thr-Lys-Pro-Gly-Tyr-His | 409 |
| Gly-Thr-Lys-Pro-Gly-His-His | Gly-Thr-Lys-Pro-Gly-His-His | Gly-Thr-Lys-Pro-Gly-His-His | 410 |
| Gly-Thr-Lys-Pro-Gly-Pro-His | Gly-Thr-Lys-Pro-Gly-Pro-His | Gly-Thr-Lys-Pro-Gly-Pro-His | 411 |
| Gly-Thr-Lys-Pro-Gly-Lys-His | Gly-Thr-Lys-Pro-Gly-Lys-His | Gly-Thr-Lys-Pro-Gly-Lys-His | 412 |
| Gly-Thr-Lys-Pro-Asp-His | Gly-Thr-Lys-Pro-Asp-His | Gly-Thr-Lys-Pro-Asp-His | 413 |
| Gly-Thr-Lys-Pro-Asp-Arg-His | Gly-Thr-Lys-Pro-Asp-Arg-His | Gly-Thr-Lys-Pro-Asp-Arg-His | 414 |
| Gly-Thr-Lys-Pro-Asp-Phe-His | Gly-Thr-Lys-Pro-Asp-Phe-His | Gly-Thr-Lys-Pro-Asp-Phe-His | 415 |
| Gly-Thr-Lys-Pro-Asp-Tyr-His | Gly-Thr-Lys-Pro-Asp-Tyr-His | Gly-Thr-Lys-Pro-Asp-Tyr-His | 416 |
| Gly-Thr-Lys-Pro-Asp-His-His | Gly-Thr-Lys-Pro-Asp-His-His | Gly-Thr-Lys-Pro-Asp-His-His | 417 |
| Gly-Thr-Lys-Pro-Asp-Pro-His | Gly-Thr-Lys-Pro-Asp-Pro-His | Gly-Thr-Lys-Pro-Asp-Pro-His | 418 |
| Gly-Thr-Lys-Pro-Asp-Lys-His | Gly-Thr-Lys-Pro-Asp-Lys-His | Gly-Thr-Lys-Pro-Asp-Lys-His | 419 |
| Gly-Thr-Lys-Pro-Trp-His | Gly-Thr-Lys-Pro-Trp-His | Gly-Thr-Lys-Pro-Trp-His | 420 |
| Gly-Thr-Lys-Pro-Trp-Arg-His | Gly-Thr-Lys-Pro-Trp-Arg-His | Gly-Thr-Lys-Pro-Trp-Arg-His | 421 |
| Gly-Thr-Lys-Pro-Trp-Phe-His | Gly-Thr-Lys-Pro-Trp-Phe-His | Gly-Thr-Lys-Pro-Trp-Phe-His | 422 |
| Gly-Thr-Lys-Pro-Trp-Tyr-His | Gly-Thr-Lys-Pro-Trp-Tyr-His | Gly-Thr-Lys-Pro-Trp-Tyr-His | 423 |
| Gly-Thr-Lys-Pro-Trp-His-His | Gly-Thr-Lys-Pro-Trp-His-His | Gly-Thr-Lys-Pro-Trp-His-His | 424 |
| Gly-Thr-Lys-Pro-Trp-Pro-His | Gly-Thr-Lys-Pro-Trp-Pro-His | Gly-Thr-Lys-Pro-Trp-Pro-His | 425 |
| Gly-Thr-Lys-Pro-Trp-Lys-His | Gly-Thr-Lys-Pro-Trp-Lys-His | Gly-Thr-Lys-Pro-Trp-Lys-His | 426 |
| Gly-Thr-Lys-Pro-Gln-His | Gly-Thr-Lys-Pro-Gln-His | Gly-Thr-Lys-Pro-Gln-His | 427 |
| Gly-Thr-Lys-Pro-Gln-Arg-His | Gly-Thr-Lys-Pro-Gln-Arg-His | Gly-Thr-Lys-Pro-Gln-Arg-His | 428 |
| Gly-Thr-Lys-Pro-Gln-Phe-His | Gly-Thr-Lys-Pro-Gln-Phe-His | Gly-Thr-Lys-Pro-Gln-Phe-His | 429 |
| Gly-Thr-Lys-Pro-Gln-Tyr-His | Gly-Thr-Lys-Pro-Gln-Tyr-His | Gly-Thr-Lys-Pro-Gln-Tyr-His | 430 |
| Gly-Thr-Lys-Pro-Gln-His-His | Gly-Thr-Lys-Pro-Gln-His-His | Gly-Thr-Lys-Pro-Gln-His-His | 431 |
| Gly-Thr-Lys-Pro-Gln-Pro-His | Gly-Thr-Lys-Pro-Gln-Pro-His | Gly-Thr-Lys-Pro-Gln-Pro-His | 432 |
| Gly-Thr-Lys-Pro-Gln-Lys-His | Gly-Thr-Lys-Pro-Gln-Lys-His | Gly-Thr-Lys-Pro-Gln-Lys-His | 433 |
| Gly-Thr-Lys-Pro-Asn-His | Gly-Thr-Lys-Pro-Asn-His | Gly-Thr-Lys-Pro-Asn-His | 434 |
| Gly-Thr-Lys-Pro-Asn-Arg-His | Gly-Thr-Lys-Pro-Asn-Arg-His | Gly-Thr-Lys-Pro-Asn-Arg-His | 435 |
| Gly-Thr-Lys-Pro-Asn-Phe-His | Gly-Thr-Lys-Pro-Asn-Phe-His | Gly-Thr-Lys-Pro-Asn-Phe-His | 436 |
| Gly-Thr-Lys-Pro-Asn-Tyr-His | Gly-Thr-Lys-Pro-Asn-Tyr-His | Gly-Thr-Lys-Pro-Asn-Tyr-His | 437 |
| Gly-Thr-Lys-Pro-Asn-His-His | Gly-Thr-Lys-Pro-Asn-His-His | Gly-Thr-Lys-Pro-Asn-His-His | 438 |
| Gly-Thr-Lys-Pro-Asn-Pro-His | Gly-Thr-Lys-Pro-Asn-Pro-His | Gly-Thr-Lys-Pro-Asn-Pro-His | 439 |
| Gly-Thr-Lys-Pro-Asn-Lys-His | Gly-Thr-Lys-Pro-Asn-Lys-His | Gly-Thr-Lys-Pro-Asn-Lys-His | 440 |
| Gly-Thr-Lys-Pro-Tyr-His | Gly-Thr-Lys-Pro-Tyr-His | Gly-Thr-Lys-Pro-Tyr-His | 441 |
| Gly-Thr-Lys-Pro-Tyr-Arg-His | Gly-Thr-Lys-Pro-Tyr-Arg-His | Gly-Thr-Lys-Pro-Tyr-Arg-His | 442 |
| Gly-Thr-Lys-Pro-Tyr-Phe-His | Gly-Thr-Lys-Pro-Tyr-Phe-His | Gly-Thr-Lys-Pro-Tyr-Phe-His | 443 |
| Gly-Thr-Lys-Pro-Tyr-Tyr-His | Gly-Thr-Lys-Pro-Tyr-Tyr-His | Gly-Thr-Lys-Pro-Tyr-Tyr-His | 444 |
| Gly-Thr-Lys-Pro-Tyr-His-His | Gly-Thr-Lys-Pro-Tyr-His-His | Gly-Thr-Lys-Pro-Tyr-His-His | 445 |
| Gly-Thr-Lys-Pro-Tyr-Pro-His | Gly-Thr-Lys-Pro-Tyr-Pro-His | Gly-Thr-Lys-Pro-Tyr-Pro-His | 446 |

TABLE 1-continued

| X-OH | X-OCH₃ | X-NH₂ | SEQ ID NO |
|---|---|---|---|
| Gly-Thr-Lys-Pro-Tyr-Lys-His | Gly-Thr-Lys-Pro-Tyr-Lys-His | Gly-Thr-Lys-Pro-Tyr-Lys-His | 447 |
| Gly-Thr-Lys-Pro-Arg-His | Gly-Thr-Lys-Pro-Arg-His | Gly-Thr-Lys-Pro-Arg-His | 448 |
| Gly-Thr-Lys-Pro-Arg-Arg-His | Gly-Thr-Lys-Pro-Arg-Arg-His | Gly-Thr-Lys-Pro-Arg-Arg-His | 449 |
| Gly-Thr-Lys-Pro-Arg-Phe-His | Gly-Thr-Lys-Pro-Arg-Phe-His | Gly-Thr-Lys-Pro-Arg-Phe-His | 450 |
| Gly-Thr-Lys-Pro-Arg-Tyr-His | Gly-Thr-Lys-Pro-Arg-Tyr-His | Gly-Thr-Lys-Pro-Arg-Tyr-His | 451 |
| Gly-Thr-Lys-Pro-Arg-His-His | Gly-Thr-Lys-Pro-Arg-His-His | Gly-Thr-Lys-Pro-Arg-His-His | 452 |
| Gly-Thr-Lys-Pro-Arg-Pro-His | Gly-Thr-Lys-Pro-Arg-Pro-His | Gly-Thr-Lys-Pro-Arg-Pro-His | 453 |
| Gly-Thr-Lys-Pro-Arg-Lys-His | Gly-Thr-Lys-Pro-Arg-Lys-His | Gly-Thr-Lys-Pro-Arg-Lys-His | 454 |
| Thr-Lys-Pro | Thr-Lys-Pro | Thr-Lys-Pro | 455 |
| Thr-Lys-Pro-Gly-Arg | Thr-Lys-Pro-Gly-Arg | Thr-Lys-Pro-Gly-Arg | 456 |
| Thr-Lys-Pro-Gly-Phe | Thr-Lys-Pro-Gly-Phe | Thr-Lys-Pro-Gly-Phe | 457 |
| Thr-Lys-Pro-Gly-Tyr | Thr-Lys-Pro-Gly-Tyr | Thr-Lys-Pro-Gly-Tyr | 458 |
| Thr-Lys-Pro-Gly-His | Thr-Lys-Pro-Gly-His | Thr-Lys-Pro-Gly-His | 459 |
| Thr-Lys-Pro-Gly-Pro | Thr-Lys-Pro-Gly-Pro | Thr-Lys-Pro-Gly-Pro | 460 |
| Thr-Lys-Pro-Gly-Lys | Thr-Lys-Pro-Gly-Lys | Thr-Lys-Pro-Gly-Lys | 461 |
| Thr-Lys-Pro-Asp-Arg | Thr-Lys-Pro-Asp-Arg | Thr-Lys-Pro-Asp-Arg | 462 |
| Thr-Lys-Pro-Asp-Phe | Thr-Lys-Pro-Asp-Phe | Thr-Lys-Pro-Asp-Phe | 463 |
| Thr-Lys-Pro-Asp-Tyr | Thr-Lys-Pro-Asp-Tyr | Thr-Lys-Pro-Asp-Tyr | 464 |
| Thr-Lys-Pro-Asp-His | Thr-Lys-Pro-Asp-His | Thr-Lys-Pro-Asp-His | 465 |
| Thr-Lys-Pro-Asp-Pro | Thr-Lys-Pro-Asp-Pro | Thr-Lys-Pro-Asp-Pro | 466 |
| Thr-Lys-Pro-Asp-Lys | Thr-Lys-Pro-Asp-Lys | Thr-Lys-Pro-Asp-Lys | 467 |
| Thr-Lys-Pro-Trp-Arg | Thr-Lys-Pro-Trp-Arg | Thr-Lys-Pro-Trp-Arg | 468 |
| Thr-Lys-Pro-Trp-Phe | Thr-Lys-Pro-Trp-Phe | Thr-Lys-Pro-Trp-Phe | 469 |
| Thr-Lys-Pro-Trp-Tyr | Thr-Lys-Pro-Trp-Tyr | Thr-Lys-Pro-Trp-Tyr | 470 |
| Thr-Lys-Pro-Trp-His | Thr-Lys-Pro-Trp-His | Thr-Lys-Pro-Trp-His | 471 |
| Thr-Lys-Pro-Trp-Pro | Thr-Lys-Pro-Trp-Pro | Thr-Lys-Pro-Trp-Pro | 472 |
| Thr-Lys-Pro-Trp-Lys | Thr-Lys-Pro-Trp-Lys | Thr-Lys-Pro-Trp-Lys | 473 |
| Thr-Lys-Pro-Gln-Arg | Thr-Lys-Pro-Gln-Arg | Thr-Lys-Pro-Gln-Arg | 474 |
| Thr-Lys-Pro-Gln-Phe | Thr-Lys-Pro-Gln-Phe | Thr-Lys-Pro-Gln-Phe | 475 |
| Thr-Lys-Pro-Gln-Tyr | Thr-Lys-Pro-Gln-Tyr | Thr-Lys-Pro-Gln-Tyr | 476 |
| Thr-Lys-Pro-Gln-His | Thr-Lys-Pro-Gln-His | Thr-Lys-Pro-Gln-His | 477 |
| Thr-Lys-Pro-Gln-Pro | Thr-Lys-Pro-Gln-Pro | Thr-Lys-Pro-Gln-Pro | 478 |
| Thr-Lys-Pro-Gln-Lys | Thr-Lys-Pro-Gln-Lys | Thr-Lys-Pro-Gln-Lys | 479 |
| Thr-Lys-Pro-Asn-Arg | Thr-Lys-Pro-Asn-Arg | Thr-Lys-Pro-Asn-Arg | 480 |
| Thr-Lys-Pro-Asn-Phe | Thr-Lys-Pro-Asn-Phe | Thr-Lys-Pro-Asn-Phe | 481 |
| Thr-Lys-Pro-Asn-Tyr | Thr-Lys-Pro-Asn-Tyr | Thr-Lys-Pro-Asn-Tyr | 482 |
| Thr-Lys-Pro-Asn-His | Thr-Lys-Pro-Asn-His | Thr-Lys-Pro-Asn-His | 483 |
| Thr-Lys-Pro-Asn-Pro | Thr-Lys-Pro-Asn-Pro | Thr-Lys-Pro-Asn-Pro | 484 |

TABLE 1-continued

| X-OH | X-OCH₃ | X-NH₂ | SEQ ID NO |
|---|---|---|---|
| Thr-Lys-Pro-Asn-Lys | Thr-Lys-Pro-Asn-Lys | Thr-Lys-Pro-Asn-Lys | 485 |
| Thr-Lys-Pro-Tyr-Arg | Thr-Lys-Pro-Tyr-Arg | Thr-Lys-Pro-Tyr-Arg | 486 |
| Thr-Lys-Pro-Tyr-Phe | Thr-Lys-Pro-Tyr-Phe | Thr-Lys-Pro-Tyr-Phe | 487 |
| Thr-Lys-Pro-Tyr-Tyr | Thr-Lys-Pro-Tyr-Tyr | Thr-Lys-Pro-Tyr-Tyr | 488 |
| Thr-Lys-Pro-Tyr-His | Thr-Lys-Pro-Tyr-His | Thr-Lys-Pro-Tyr-His | 489 |
| Thr-Lys-Pro-Tyr-Pro | Thr-Lys-Pro-Tyr-Pro | Thr-Lys-Pro-Tyr-Pro | 490 |
| Thr-Lys-Pro-Tyr-Lys | Thr-Lys-Pro-Tyr-Lys | Thr-Lys-Pro-Tyr-Lys | 491 |
| Thr-Lys-Pro-Arg-Arg | Thr-Lys-Pro-Arg-Arg | Thr-Lys-Pro-Arg-Arg | 492 |
| Thr-Lys-Pro-Arg-Phe | Thr-Lys-Pro-Arg-Phe | Thr-Lys-Pro-Arg-Phe | 493 |
| Thr-Lys-Pro-Arg-Tyr | Thr-Lys-Pro-Arg-Tyr | Thr-Lys-Pro-Arg-Tyr | 494 |
| Thr-Lys-Pro-Arg-His | Thr-Lys-Pro-Arg-His | Thr-Lys-Pro-Arg-His | 495 |
| Thr-Lys-Pro-Arg-Pro | Thr-Lys-Pro-Arg-Pro | Thr-Lys-Pro-Arg-Pro | 6 |
| Thr-Lys-Pro-Arg-Lys | Thr-Lys-Pro-Arg-Lys | Thr-Lys-Pro-Arg-Lys | 496 |
| Met-Thr-Lys-Pro-Arg | Met-Thr-Lys-Pro-Arg | Met-Thr-Lys-Pro-Arg | 497 |
| Met-Thr-Lys-Pro-Phe | Met-Thr-Lys-Pro-Phe | Met-Thr-Lys-Pro-Phe | 498 |
| Met-Thr-Lys-Pro-Tyr | Met-Thr-Lys-Pro-Tyr | Met-Thr-Lys-Pro-Tyr | 499 |
| Met-Thr-Lys-Pro-Gly | Met-Thr-Lys-Pro-Gly | Met-Thr-Lys-Pro-Gly | 500 |
| Met-Thr-Lys-Pro-His | Met-Thr-Lys-Pro-His | Met-Thr-Lys-Pro-His | 501 |
| Met-Thr-Lys-Pro-Lys | Met-Thr-Lys-Pro-Lys | Met-Thr-Lys-Pro-Lys | 502 |
| Met-Thr-Lys-Pro-Gly | Met-Thr-Lys-Pro-Gly | Met-Thr-Lys-Pro-Gly | 503 |
| Met-Thr-Lys-Pro-Gly-Arg | Met-Thr-Lys-Pro-Gly-Arg | Met-Thr-Lys-Pro-Gly-Arg | 504 |
| Met-Thr-Lys-Pro-Gly-Phe | Met-Thr-Lys-Pro-Gly-Phe | Met-Thr-Lys-Pro-Gly-Phe | 505 |
| Met-Thr-Lys-Pro-Gly-Tyr | Met-Thr-Lys-Pro-Gly-Tyr | Met-Thr-Lys-Pro-Gly-Tyr | 506 |
| Met-Thr-Lys-Pro-Gly-His | Met-Thr-Lys-Pro-Gly-His | Met-Thr-Lys-Pro-Gly-His | 507 |
| Met-Thr-Lys-Pro-Gly-Pro | Met-Thr-Lys-Pro-Gly-Pro | Met-Thr-Lys-Pro-Gly-Pro | 508 |
| Met-Thr-Lys-Pro-Gly-Lys | Met-Thr-Lys-Pro-Gly-Lys | Met-Thr-Lys-Pro-Gly-Lys | 509 |
| Met-Thr-Lys-Pro-Asp | Met-Thr-Lys-Pro-Asp | Met-Thr-Lys-Pro-Asp | 510 |
| Met-Thr-Lys-Pro-Asp-Arg | Met-Thr-Lys-Pro-Asp-Arg | Met-Thr-Lys-Pro-Asp-Arg | 511 |
| Met-Thr-Lys-Pro-Asp-Phe | Met-Thr-Lys-Pro-Asp-Phe | Met-Thr-Lys-Pro-Asp-Phe | 512 |
| Met-Thr-Lys-Pro-Asp-Tyr | Met-Thr-Lys-Pro-Asp-Tyr | Met-Thr-Lys-Pro-Asp-Tyr | 513 |
| Met-Thr-Lys-Pro-Asp-His | Met-Thr-Lys-Pro-Asp-His | Met-Thr-Lys-Pro-Asp-His | 514 |
| Met-Thr-Lys-Pro-Asp-Pro | Met-Thr-Lys-Pro-Asp-Pro | Met-Thr-Lys-Pro-Asp-Pro | 515 |
| Met-Thr-Lys-Pro-Asp-Lys | Met-Thr-Lys-Pro-Asp-Lys | Met-Thr-Lys-Pro-Asp-Lys | 516 |
| Met-Thr-Lys-Pro-Trp | Met-Thr-Lys-Pro-Trp | Met-Thr-Lys-Pro-Trp | 517 |
| Met-Thr-Lys-Pro-Trp-Arg | Met-Thr-Lys-Pro-Trp-Arg | Met-Thr-Lys-Pro-Trp-Arg | 518 |
| Met-Thr-Lys-Pro-Trp-Phe | Met-Thr-Lys-Pro-Trp-Phe | Met-Thr-Lys-Pro-Trp-Phe | 519 |
| Met-Thr-Lys-Pro-Trp-Tyr | Met-Thr-Lys-Pro-Trp-Tyr | Met-Thr-Lys-Pro-Trp-Tyr | 520 |
| Met-Thr-Lys-Pro-Trp-His | Met-Thr-Lys-Pro-Trp-His | Met-Thr-Lys-Pro-Trp-His | 521 |

TABLE 1-continued

| X-OH | X-OCH₃ | X-NH₂ | SEQ ID NO |
|---|---|---|---|
| Met-Thr-Lys-Pro-Trp-Pro | Met-Thr-Lys-Pro-Trp-Pro | Met-Thr-Lys-Pro-Trp-Pro | 522 |
| Met-Thr-Lys-Pro-Trp-Lys | Met-Thr-Lys-Pro-Trp-Lys | Met-Thr-Lys-Pro-Trp-Lys | 523 |
| Met-Thr-Lys-Pro-Gln | Met-Thr-Lys-Pro-Gln | Met-Thr-Lys-Pro-Gln | 524 |
| Met-Thr-Lys-Pro-Gln-Arg | Met-Thr-Lys-Pro-Gln-Arg | Met-Thr-Lys-Pro-Gln-Arg | 525 |
| Met-Thr-Lys-Pro-Gln-Phe | Met-Thr-Lys-Pro-Gln-Phe | Met-Thr-Lys-Pro-Gln-Phe | 526 |
| Met-Thr-Lys-Pro-Gln-Tyr | Met-Thr-Lys-Pro-Gln-Tyr | Met-Thr-Lys-Pro-Gln-Tyr | 527 |
| Met-Thr-Lys-Pro-Gln-His | Met-Thr-Lys-Pro-Gln-His | Met-Thr-Lys-Pro-Gln-His | 528 |
| Met-Thr-Lys-Pro-Gln-Pro | Met-Thr-Lys-Pro-Gln-Pro | Met-Thr-Lys-Pro-Gln-Pro | 529 |
| Met-Thr-Lys-Pro-Gln-Lys | Met-Thr-Lys-Pro-Gln-Lys | Met-Thr-Lys-Pro-Gln-Lys | 530 |
| Met-Thr-Lys-Pro-Asn | Met-Thr-Lys-Pro-Asn | Met-Thr-Lys-Pro-Asn | 531 |
| Met-Thr-Lys-Pro-Asn-Arg | Met-Thr-Lys-Pro-Asn-Arg | Met-Thr-Lys-Pro-Asn-Arg | 532 |
| Met-Thr-Lys-Pro-Asn-Phe | Met-Thr-Lys-Pro-Asn-Phe | Met-Thr-Lys-Pro-Asn-Phe | 533 |
| Met-Thr-Lys-Pro-Asn-Tyr | Met-Thr-Lys-Pro-Asn-Tyr | Met-Thr-Lys-Pro-Asn-Tyr | 534 |
| Met-Thr-Lys-Pro-Asn-His | Met-Thr-Lys-Pro-Asn-His | Met-Thr-Lys-Pro-Asn-His | 535 |
| Met-Thr-Lys-Pro-Asn-Pro | Met-Thr-Lys-Pro-Asn-Pro | Met-Thr-Lys-Pro-Asn-Pro | 536 |
| Met-Thr-Lys-Pro-Asn-Lys | Met-Thr-Lys-Pro-Asn-Lys | Met-Thr-Lys-Pro-Asn-Lys | 537 |
| Met-Thr-Lys-Pro-Tyr | Met-Thr-Lys-Pro-Tyr | Met-Thr-Lys-Pro-Tyr | 538 |
| Met-Thr-Lys-Pro-Tyr-Arg | Met-Thr-Lys-Pro-Tyr-Arg | Met-Thr-Lys-Pro-Tyr-Arg | 539 |
| Met-Thr-Lys-Pro-Tyr-Phe | Met-Thr-Lys-Pro-Tyr-Phe | Met-Thr-Lys-Pro-Tyr-Phe | 540 |
| Met-Thr-Lys-Pro-Tyr-Tyr | Met-Thr-Lys-Pro-Tyr-Tyr | Met-Thr-Lys-Pro-Tyr-Tyr | 541 |
| Met-Thr-Lys-Pro-Tyr-His | Met-Thr-Lys-Pro-Tyr-His | Met-Thr-Lys-Pro-Tyr-His | 542 |
| Met-Thr-Lys-Pro-Tyr-Pro | Met-Thr-Lys-Pro-Tyr-Pro | Met-Thr-Lys-Pro-Tyr-Pro | 543 |
| Met-Thr-Lys-Pro-Tyr-Lys | Met-Thr-Lys-Pro-Tyr-Lys | Met-Thr-Lys-Pro-Tyr-Lys | 544 |
| Met-Thr-Lys-Pro-Arg | Met-Thr-Lys-Pro-Arg | Met-Thr-Lys-Pro-Arg | 545 |
| Met-Thr-Lys-Pro-Arg-Arg | Met-Thr-Lys-Pro-Arg-Arg | Met-Thr-Lys-Pro-Arg-Arg | 546 |
| Met-Thr-Lys-Pro-Arg-Phe | Met-Thr-Lys-Pro-Arg-Phe | Met-Thr-Lys-Pro-Arg-Phe | 547 |
| Met-Thr-Lys-Pro-Arg-Tyr | Met-Thr-Lys-Pro-Arg-Tyr | Met-Thr-Lys-Pro-Arg-Tyr | 548 |
| Met-Thr-Lys-Pro-Arg-His | Met-Thr-Lys-Pro-Arg-His | Met-Thr-Lys-Pro-Arg-His | 549 |
| Met-Thr-Lys-Pro-Arg-Pro | Met-Thr-Lys-Pro-Arg-Pro | Met-Thr-Lys-Pro-Arg-Pro | 550 |
| Met-Thr-Lys-Pro-Arg-Lys | Met-Thr-Lys-Pro-Arg-Lys | Met-Thr-Lys-Pro-Arg-Lys | 551 |
| Met(O)-Thr-Lys-Pro-Arg | Met(O)-Thr-Lys-Pro-Arg | Met(O)-Thr-Lys-Pro-Arg | 552 |
| Met(O)-Thr-Lys-Pro-Phe | Met(O)-Thr-Lys-Pro-Phe | Met(O)-Thr-Lys-Pro-Phe | 553 |
| Met(O)-Thr-Lys-Pro-Tyr | Met(O)-Thr-Lys-Pro-Tyr | Met(O)-Thr-Lys-Pro-Tyr | 554 |
| Met(O)-Thr-Lys-Pro-Gly | Met(O)-Thr-Lys-Pro-Gly | Met(O)-Thr-Lys-Pro-Gly | 555 |
| Met(O)-Thr-Lys-Pro-His | Met(O)-Thr-Lys-Pro-His | Met(O)-Thr-Lys-Pro-His | 556 |
| Met(O)-Thr-Lys-Pro-Lys | Met(O)-Thr-Lys-Pro-Lys | Met(O)-Thr-Lys-Pro-Lys | 557 |
| Met(O)-Thr-Lys-Pro-Gly | Met(O)-Thr-Lys-Pro-Gly | Met(O)-Thr-Lys-Pro-Gly | 558 |
| Met(O)-Thr-Lys-Pro-Gly-Arg | Met(O)-Thr-Lys-Pro-Gly-Arg | Met(O)-Thr-Lys-Pro-Gly-Arg | 559 |

TABLE 1-continued

| X-OH | X-OCH₃ | X-NH₂ | SEQ ID NO |
|---|---|---|---|
| Met(O)-Thr-Lys-Pro-Gly-Phe | Met(O)-Thr-Lys-Pro-Gly-Phe | Met(O)-Thr-Lys-Pro-Gly-Phe | 560 |
| Met(O)-Thr-Lys-Pro-Gly-Tyr | Met(O)-Thr-Lys-Pro-Gly-Tyr | Met(O)-Thr-Lys-Pro-Gly-Tyr | 561 |
| Met(O)-Thr-Lys-Pro-Gly-His | Met(O)-Thr-Lys-Pro-Gly-His | Met(O)-Thr-Lys-Pro-Gly-His | 562 |
| Met(O)-Thr-Lys-Pro-Gly-Pro | Met(O)-Thr-Lys-Pro-Gly-Pro | Met(O)-Thr-Lys-Pro-Gly-Pro | 563 |
| Met(O)-Thr-Lys-Pro-Gly-Lys | Met(O)-Thr-Lys-Pro-Gly-Lys | Met(O)-Thr-Lys-Pro-Gly-Lys | 564 |
| Met(O)-Thr-Lys-Pro-Asp | Met(O)-Thr-Lys-Pro-Asp | Met(O)-Thr-Lys-Pro-Asp | 565 |
| Met(O)-Thr-Lys-Pro-Asp-Arg | Met(O)-Thr-Lys-Pro-Asp-Arg | Met(O)-Thr-Lys-Pro-Asp-Arg | 566 |
| Met(O)-Thr-Lys-Pro-Asp-Phe | Met(O)-Thr-Lys-Pro-Asp-Phe | Met(O)-Thr-Lys-Pro-Asp-Phe | 567 |
| Met(O)-Thr-Lys-Pro-Asp-Tyr | Met(O)-Thr-Lys-Pro-Asp-Tyr | Met(O)-Thr-Lys-Pro-Asp-Tyr | 568 |
| Met(O)-Thr-Lys-Pro-Asp-His | Met(O)-Thr-Lys-Pro-Asp-His | Met(O)-Thr-Lys-Pro-Asp-His | 569 |
| Met(O)-Thr-Lys-Pro-Asp-Pro | Met(O)-Thr-Lys-Pro-Asp-Pro | Met(O)-Thr-Lys-Pro-Asp-Pro | 570 |
| Met(O)-Thr-Lys-Pro-Asp-Lys | Met(O)-Thr-Lys-Pro-Asp-Lys | Met(O)-Thr-Lys-Pro-Asp-Lys | 571 |
| Met(O)-Thr-Lys-Pro-Trp | Met(O)-Thr-Lys-Pro-Trp | Met(O)-Thr-Lys-Pro-Trp | 572 |
| Met(O)-Thr-Lys-Pro-Trp-Arg | Met(O)-Thr-Lys-Pro-Trp-Arg | Met(O)-Thr-Lys-Pro-Trp-Arg | 573 |
| Met(O)-Thr-Lys-Pro-Trp-Phe | Met(O)-Thr-Lys-Pro-Trp-Phe | Met(O)-Thr-Lys-Pro-Trp-Phe | 574 |
| Met(O)-Thr-Lys-Pro-Trp-Tyr | Met(O)-Thr-Lys-Pro-Trp-Tyr | Met(O)-Thr-Lys-Pro-Trp-Tyr | 575 |
| Met(O)-Thr-Lys-Pro-Trp-His | Met(O)-Thr-Lys-Pro-Trp-His | Met(O)-Thr-Lys-Pro-Trp-His | 576 |
| Met(O)-Thr-Lys-Pro-Trp-Pro | Met(O)-Thr-Lys-Pro-Trp-Pro | Met(O)-Thr-Lys-Pro-Trp-Pro | 577 |
| Met(O)-Thr-Lys-Pro-Trp-Lys | Met(O)-Thr-Lys-Pro-Trp-Lys | Met(O)-Thr-Lys-Pro-Trp-Lys | 578 |
| Met(O)-Thr-Lys-Pro-Gln | Met(O)-Thr-Lys-Pro-Gln | Met(O)-Thr-Lys-Pro-Gln | 579 |
| Met(O)-Thr-Lys-Pro-Gln-Arg | Met(O)-Thr-Lys-Pro-Gln-Arg | Met(O)-Thr-Lys-Pro-Gln-Arg | 580 |
| Met(O)-Thr-Lys-Pro-Gln-Phe | Met(O)-Thr-Lys-Pro-Gln-Phe | Met(O)-Thr-Lys-Pro-Gln-Phe | 581 |
| Met(O)-Thr-Lys-Pro-Gln-Tyr | Met(O)-Thr-Lys-Pro-Gln-Tyr | Met(O)-Thr-Lys-Pro-Gln-Tyr | 582 |
| Met(O)-Thr-Lys-Pro-Gln-His | Met(O)-Thr-Lys-Pro-Gln-His | Met(O)-Thr-Lys-Pro-Gln-His | 583 |
| Met(O)-Thr-Lys-Pro-Gln-Pro | Met(O)-Thr-Lys-Pro-Gln-Pro | Met(O)-Thr-Lys-Pro-Gln-Pro | 584 |
| Met(O)-Thr-Lys-Pro-Gln-Lys | Met(O)-Thr-Lys-Pro-Gln-Lys | Met(O)-Thr-Lys-Pro-Gln-Lys | 585 |
| Met(O)-Thr-Lys-Pro-Asn | Met(O)-Thr-Lys-Pro-Asn | Met(O)-Thr-Lys-Pro-Asn | 586 |
| Met(O)-Thr-Lys-Pro-Asn-Arg | Met(O)-Thr-Lys-Pro-Asn-Arg | Met(O)-Thr-Lys-Pro-Asn-Arg | 587 |
| Met(O)-Thr-Lys-Pro-Asn-Phe | Met(O)-Thr-Lys-Pro-Asn-Phe | Met(O)-Thr-Lys-Pro-Asn-Phe | 588 |
| Met(O)-Thr-Lys-Pro-Asn-Tyr | Met(O)-Thr-Lys-Pro-Asn-Tyr | Met(O)-Thr-Lys-Pro-Asn-Tyr | 589 |
| Met(O)-Thr-Lys-Pro-Asn-His | Met(O)-Thr-Lys-Pro-Asn-His | Met(O)-Thr-Lys-Pro-Asn-His | 590 |
| Met(O)-Thr-Lys-Pro-Asn-Pro | Met(O)-Thr-Lys-Pro-Asn-Pro | Met(O)-Thr-Lys-Pro-Asn-Pro | 591 |
| Met(O)-Thr-Lys-Pro-Asn-Lys | Met(O)-Thr-Lys-Pro-Asn-Lys | Met(O)-Thr-Lys-Pro-Asn-Lys | 592 |
| Met(O)-Thr-Lys-Pro-Tyr | Met(O)-Thr-Lys-Pro-Tyr | Met(O)-Thr-Lys-Pro-Tyr | 593 |
| Met(O)-Thr-Lys-Pro-Tyr-Arg | Met(O)-Thr-Lys-Pro-Tyr-Arg | Met(O)-Thr-Lys-Pro-Tyr-Arg | 594 |
| Met(O)-Thr-Lys-Pro-Tyr-Phe | Met(O)-Thr-Lys-Pro-Tyr-Phe | Met(O)-Thr-Lys-Pro-Tyr-Phe | 595 |
| Met(O)-Thr-Lys-Pro-Tyr-Tyr | Met(O)-Thr-Lys-Pro-Tyr-Tyr | Met(O)-Thr-Lys-Pro-Tyr-Tyr | 596 |
| Met(O)-Thr-Lys-Pro-Tyr-His | Met(O)-Thr-Lys-Pro-Tyr-His | Met(O)-Thr-Lys-Pro-Tyr-His | 597 |

TABLE 1-continued

| X-OH | X-OCH₃ | X-NH₂ | SEQ ID NO |
|---|---|---|---|
| Met(O)-Thr-Lys-Pro-Tyr-Pro | Met(O)-Thr-Lys-Pro-Tyr-Pro | Met(O)-Thr-Lys-Pro-Tyr-Pro | 598 |
| Met(O)-Thr-Lys-Pro-Tyr-Lys | Met(O)-Thr-Lys-Pro-Tyr-Lys | Met(O)-Thr-Lys-Pro-Tyr-Lys | 599 |
| Met(O)-Thr-Lys-Pro-Arg | Met(O)-Thr-Lys-Pro-Arg | Met(O)-Thr-Lys-Pro-Arg | 600 |
| Met(O)-Thr-Lys-Pro-Arg-Arg | Met(O)-Thr-Lys-Pro-Arg-Arg | Met(O)-Thr-Lys-Pro-Arg-Arg | 601 |
| Met(O)-Thr-Lys-Pro-Arg-Phe | Met(O)-Thr-Lys-Pro-Arg-Phe | Met(O)-Thr-Lys-Pro-Arg-Phe | 602 |
| Met(O)-Thr-Lys-Pro-Arg-Tyr | Met(O)-Thr-Lys-Pro-Arg-Tyr | Met(O)-Thr-Lys-Pro-Arg-Tyr | 603 |
| Met(O)-Thr-Lys-Pro-Arg-His | Met(O)-Thr-Lys-Pro-Arg-His | Met(O)-Thr-Lys-Pro-Arg-His | 604 |
| Met(O)-Thr-Lys-Pro-Arg-Pro | Met(O)-Thr-Lys-Pro-Arg-Pro | Met(O)-Thr-Lys-Pro-Arg-Pro | 605 |
| Met(O)-Thr-Lys-Pro-Arg-Lys | Met(O)-Thr-Lys-Pro-Arg-Lys | Met(O)-Thr-Lys-Pro-Arg-Lys | 606 |
| Thr-Thr-Lys-Pro-Arg | Thr-Thr-Lys-Pro-Arg | Thr-Thr-Lys-Pro-Arg | 607 |
| Thr-Thr-Lys-Pro-Phe | Thr-Thr-Lys-Pro-Phe | Thr-Thr-Lys-Pro-Phe | 608 |
| Thr-Thr-Lys-Pro-Tyr | Thr-Thr-Lys-Pro-Tyr | Thr-Thr-Lys-Pro-Tyr | 609 |
| Thr-Thr-Lys-Pro-Gly | Thr-Thr-Lys-Pro-Gly | Thr-Thr-Lys-Pro-Gly | 610 |
| Thr-Thr-Lys-Pro-His | Thr-Thr-Lys-Pro-His | Thr-Thr-Lys-Pro-His | 611 |
| Thr-Thr-Lys-Pro-Lys | Thr-Thr-Lys-Pro-Lys | Thr-Thr-Lys-Pro-Lys | 612 |
| Thr-Thr-Lys-Pro-Gly | Thr-Thr-Lys-Pro-Gly | Thr-Thr-Lys-Pro-Gly | 613 |
| Thr-Thr-Lys-Pro-Gly-Arg | Thr-Thr-Lys-Pro-Gly-Arg | Thr-Thr-Lys-Pro-Gly-Arg | 614 |
| Thr-Thr-Lys-Pro-Gly-Phe | Thr-Thr-Lys-Pro-Gly-Phe | Thr-Thr-Lys-Pro-Gly-Phe | 615 |
| Thr-Thr-Lys-Pro-Gly-Tyr | Thr-Thr-Lys-Pro-Gly-Tyr | Thr-Thr-Lys-Pro-Gly-Tyr | 616 |
| Thr-Thr-Lys-Pro-Gly-His | Thr-Thr-Lys-Pro-Gly-His | Thr-Thr-Lys-Pro-Gly-His | 617 |
| Thr-Thr-Lys-Pro-Gly-Pro | Thr-Thr-Lys-Pro-Gly-Pro | Thr-Thr-Lys-Pro-Gly-Pro | 618 |
| Thr-Thr-Lys-Pro-Gly-Lys | Thr-Thr-Lys-Pro-Gly-Lys | Thr-Thr-Lys-Pro-Gly-Lys | 619 |
| Thr-Thr-Lys-Pro-Asp | Thr-Thr-Lys-Pro-Asp | Thr-Thr-Lys-Pro-Asp | 620 |
| Thr-Thr-Lys-Pro-Asp-Arg | Thr-Thr-Lys-Pro-Asp-Arg | Thr-Thr-Lys-Pro-Asp-Arg | 621 |
| Thr-Thr-Lys-Pro-Asp-Phe | Thr-Thr-Lys-Pro-Asp-Phe | Thr-Thr-Lys-Pro-Asp-Phe | 622 |
| Thr-Thr-Lys-Pro-Asp-Tyr | Thr-Thr-Lys-Pro-Asp-Tyr | Thr-Thr-Lys-Pro-Asp-Tyr | 623 |
| Thr-Thr-Lys-Pro-Asp-His | Thr-Thr-Lys-Pro-Asp-His | Thr-Thr-Lys-Pro-Asp-His | 624 |
| Thr-Thr-Lys-Pro-Asp-Pro | Thr-Thr-Lys-Pro-Asp-Pro | Thr-Thr-Lys-Pro-Asp-Pro | 625 |
| Thr-Thr-Lys-Pro-Asp-Lys | Thr-Thr-Lys-Pro-Asp-Lys | Thr-Thr-Lys-Pro-Asp-Lys | 626 |
| Thr-Thr-Lys-Pro-Trp | Thr-Thr-Lys-Pro-Trp | Thr-Thr-Lys-Pro-Trp | 627 |
| Thr-Thr-Lys-Pro-Trp-Arg | Thr-Thr-Lys-Pro-Trp-Arg | Thr-Thr-Lys-Pro-Trp-Arg | 628 |
| Thr-Thr-Lys-Pro-Trp-Phe | Thr-Thr-Lys-Pro-Trp-Phe | Thr-Thr-Lys-Pro-Trp-Phe | 629 |
| Thr-Thr-Lys-Pro-Trp-Tyr | Thr-Thr-Lys-Pro-Trp-Tyr | Thr-Thr-Lys-Pro-Trp-Tyr | 630 |
| Thr-Thr-Lys-Pro-Trp-His | Thr-Thr-Lys-Pro-Trp-His | Thr-Thr-Lys-Pro-Trp-His | 631 |
| Thr-Thr-Lys-Pro-Trp-Pro | Thr-Thr-Lys-Pro-Trp-Pro | Thr-Thr-Lys-Pro-Trp-Pro | 632 |
| Thr-Thr-Lys-Pro-Trp-Lys | Thr-Thr-Lys-Pro-Trp-Lys | Thr-Thr-Lys-Pro-Trp-Lys | 633 |
| Thr-Thr-Lys-Pro-Gln | Thr-Thr-Lys-Pro-Gln | Thr-Thr-Lys-Pro-Gln | 634 |
| Thr-Thr-Lys-Pro-Gln-Arg | Thr-Thr-Lys-Pro-Gln-Arg | Thr-Thr-Lys-Pro-Gln-Arg | 635 |

TABLE 1-continued

| X-OH | X-OCH₃ | X-NH₂ | SEQ ID NO |
|---|---|---|---|
| Thr-Thr-Lys-Pro-Gln-Phe | Thr-Thr-Lys-Pro-Gln-Phe | Thr-Thr-Lys-Pro-Gln-Phe | 636 |
| Thr-Thr-Lys-Pro-Gln-Tyr | Thr-Thr-Lys-Pro-Gln-Tyr | Thr-Thr-Lys-Pro-Gln-Tyr | 637 |
| Thr-Thr-Lys-Pro-Gln-His | Thr-Thr-Lys-Pro-Gln-His | Thr-Thr-Lys-Pro-Gln-His | 638 |
| Thr-Thr-Lys-Pro-Gln-Pro | Thr-Thr-Lys-Pro-Gln-Pro | Thr-Thr-Lys-Pro-Gln-Pro | 639 |
| Thr-Thr-Lys-Pro-Gln-Lys | Thr-Thr-Lys-Pro-Gln-Lys | Thr-Thr-Lys-Pro-Gln-Lys | 640 |
| Thr-Thr-Lys-Pro-Asn | Thr-Thr-Lys-Pro-Asn | Thr-Thr-Lys-Pro-Asn | 641 |
| Thr-Thr-Lys-Pro-Asn-Arg | Thr-Thr-Lys-Pro-Asn-Arg | Thr-Thr-Lys-Pro-Asn-Arg | 642 |
| Thr-Thr-Lys-Pro-Asn-Phe | Thr-Thr-Lys-Pro-Asn-Phe | Thr-Thr-Lys-Pro-Asn-Phe | 643 |
| Thr-Thr-Lys-Pro-Asn-Tyr | Thr-Thr-Lys-Pro-Asn-Tyr | Thr-Thr-Lys-Pro-Asn-Tyr | 644 |
| Thr-Thr-Lys-Pro-Asn-His | Thr-Thr-Lys-Pro-Asn-His | Thr-Thr-Lys-Pro-Asn-His | 645 |
| Thr-Thr-Lys-Pro-Asn-Pro | Thr-Thr-Lys-Pro-Asn-Pro | Thr-Thr-Lys-Pro-Asn-Pro | 646 |
| Thr-Thr-Lys-Pro-Asn-Lys | Thr-Thr-Lys-Pro-Asn-Lys | Thr-Thr-Lys-Pro-Asn-Lys | 647 |
| Thr-Thr-Lys-Pro-Tyr | Thr-Thr-Lys-Pro-Tyr | Thr-Thr-Lys-Pro-Tyr | 648 |
| Thr-Thr-Lys-Pro-Tyr-Arg | Thr-Thr-Lys-Pro-Tyr-Arg | Thr-Thr-Lys-Pro-Tyr-Arg | 649 |
| Thr-Thr-Lys-Pro-Tyr-Phe | Thr-Thr-Lys-Pro-Tyr-Phe | Thr-Thr-Lys-Pro-Tyr-Phe | 650 |
| Thr-Thr-Lys-Pro-Tyr-Tyr | Thr-Thr-Lys-Pro-Tyr-Tyr | Thr-Thr-Lys-Pro-Tyr-Tyr | 651 |
| Thr-Thr-Lys-Pro-Tyr-His | Thr-Thr-Lys-Pro-Tyr-His | Thr-Thr-Lys-Pro-Tyr-His | 652 |
| Thr-Thr-Lys-Pro-Tyr-Pro | Thr-Thr-Lys-Pro-Tyr-Pro | Thr-Thr-Lys-Pro-Tyr-Pro | 653 |
| Thr-Thr-Lys-Pro-Tyr-Lys | Thr-Thr-Lys-Pro-Tyr-Lys | Thr-Thr-Lys-Pro-Tyr-Lys | 654 |
| Thr-Thr-Lys-Pro-Arg | Thr-Thr-Lys-Pro-Arg | Thr-Thr-Lys-Pro-Arg | 655 |
| Thr-Thr-Lys-Pro-Arg-Arg | Thr-Thr-Lys-Pro-Arg-Arg | Thr-Thr-Lys-Pro-Arg-Arg | 656 |
| Thr-Thr-Lys-Pro-Arg-Phe | Thr-Thr-Lys-Pro-Arg-Phe | Thr-Thr-Lys-Pro-Arg-Phe | 657 |
| Thr-Thr-Lys-Pro-Arg-Tyr | Thr-Thr-Lys-Pro-Arg-Tyr | Thr-Thr-Lys-Pro-Arg-Tyr | 658 |
| Thr-Thr-Lys-Pro-Arg-His | Thr-Thr-Lys-Pro-Arg-His | Thr-Thr-Lys-Pro-Arg-His | 659 |
| Thr-Thr-Lys-Pro-Arg-Pro | Thr-Thr-Lys-Pro-Arg-Pro | Thr-Thr-Lys-Pro-Arg-Pro | 660 |
| Thr-Thr-Lys-Pro-Arg-Lys | Thr-Thr-Lys-Pro-Arg-Lys | Thr-Thr-Lys-Pro-Arg-Lys | 661 |
| Ala-Thr-Lys-Pro-Arg | Ala-Thr-Lys-Pro-Arg | Ala-Thr-Lys-Pro-Arg | 662 |
| Ala-Thr-Lys-Pro-Phe | Ala-Thr-Lys-Pro-Phe | Ala-Thr-Lys-Pro-Phe | 663 |
| Ala-Thr-Lys-Pro-Tyr | Ala-Thr-Lys-Pro-Tyr | Ala-Thr-Lys-Pro-Tyr | 664 |
| Ala-Thr-Lys-Pro-Gly | Ala-Thr-Lys-Pro-Gly | Ala-Thr-Lys-Pro-Gly | 665 |
| Ala-Thr-Lys-Pro-His | Ala-Thr-Lys-Pro-His | Ala-Thr-Lys-Pro-His | 666 |
| Ala-Thr-Lys-Pro-Lys | Ala-Thr-Lys-Pro-Lys | Ala-Thr-Lys-Pro-Lys | 667 |
| Ala-Thr-Lys-Pro-Gly | Ala-Thr-Lys-Pro-Gly | Ala-Thr-Lys-Pro-Gly | 668 |
| Ala-Thr-Lys-Pro-Gly-Arg | Ala-Thr-Lys-Pro-Gly-Arg | Ala-Thr-Lys-Pro-Gly-Arg | 669 |
| Ala-Thr-Lys-Pro-Gly-Phe | Ala-Thr-Lys-Pro-Gly-Phe | Ala-Thr-Lys-Pro-Gly-Phe | 670 |
| Ala-Thr-Lys-Pro-Gly-Tyr | Ala-Thr-Lys-Pro-Gly-Tyr | Ala-Thr-Lys-Pro-Gly-Tyr | 671 |
| Ala-Thr-Lys-Pro-Gly-His | Ala-Thr-Lys-Pro-Gly-His | Ala-Thr-Lys-Pro-Gly-His | 672 |
| Ala-Thr-Lys-Pro-Gly-Pro | Ala-Thr-Lys-Pro-Gly-Pro | Ala-Thr-Lys-Pro-Gly-Pro | 673 |

TABLE 1-continued

| X-OH | X-OCH₃ | X-NH₂ | SEQ ID NO |
|---|---|---|---|
| Ala-Thr-Lys-Pro-Gly-Lys | Ala-Thr-Lys-Pro-Gly-Lys | Ala-Thr-Lys-Pro-Gly-Lys | 674 |
| Ala-Thr-Lys-Pro-Asp | Ala-Thr-Lys-Pro-Asp | Ala-Thr-Lys-Pro-Asp | 675 |
| Ala-Thr-Lys-Pro-Asp-Arg | Ala-Thr-Lys-Pro-Asp-Arg | Ala-Thr-Lys-Pro-Asp-Arg | 676 |
| Ala-Thr-Lys-Pro-Asp-Phe | Ala-Thr-Lys-Pro-Asp-Phe | Ala-Thr-Lys-Pro-Asp-Phe | 677 |
| Ala-Thr-Lys-Pro-Asp-Tyr | Ala-Thr-Lys-Pro-Asp-Tyr | Ala-Thr-Lys-Pro-Asp-Tyr | 678 |
| Ala-Thr-Lys-Pro-Asp-His | Ala-Thr-Lys-Pro-Asp-His | Ala-Thr-Lys-Pro-Asp-His | 679 |
| Ala-Thr-Lys-Pro-Asp-Pro | Ala-Thr-Lys-Pro-Asp-Pro | Ala-Thr-Lys-Pro-Asp-Pro | 680 |
| Ala-Thr-Lys-Pro-Asp-Lys | Ala-Thr-Lys-Pro-Asp-Lys | Ala-Thr-Lys-Pro-Asp-Lys | 681 |
| Ala-Thr-Lys-Pro-Trp | Ala-Thr-Lys-Pro-Trp | Ala-Thr-Lys-Pro-Trp | 682 |
| Ala-Thr-Lys-Pro-Trp-Arg | Ala-Thr-Lys-Pro-Trp-Arg | Ala-Thr-Lys-Pro-Trp-Arg | 683 |
| Ala-Thr-Lys-Pro-Trp-Phe | Ala-Thr-Lys-Pro-Trp-Phe | Ala-Thr-Lys-Pro-Trp-Phe | 684 |
| Ala-Thr-Lys-Pro-Trp-Tyr | Ala-Thr-Lys-Pro-Trp-Tyr | Ala-Thr-Lys-Pro-Trp-Tyr | 685 |
| Ala-Thr-Lys-Pro-Trp-His | Ala-Thr-Lys-Pro-Trp-His | Ala-Thr-Lys-Pro-Trp-His | 686 |
| Ala-Thr-Lys-Pro-Trp-Pro | Ala-Thr-Lys-Pro-Trp-Pro | Ala-Thr-Lys-Pro-Trp-Pro | 687 |
| Ala-Thr-Lys-Pro-Trp-Lys | Ala-Thr-Lys-Pro-Trp-Lys | Ala-Thr-Lys-Pro-Trp-Lys | 688 |
| Ala-Thr-Lys-Pro-Gln | Ala-Thr-Lys-Pro-Gln | Ala-Thr-Lys-Pro-Gln | 689 |
| Ala-Thr-Lys-Pro-Gln-Arg | Ala-Thr-Lys-Pro-Gln-Arg | Ala-Thr-Lys-Pro-Gln-Arg | 690 |
| Ala-Thr-Lys-Pro-Gln-Phe | Ala-Thr-Lys-Pro-Gln-Phe | Ala-Thr-Lys-Pro-Gln-Phe | 691 |
| Ala-Thr-Lys-Pro-Gln-Tyr | Ala-Thr-Lys-Pro-Gln-Tyr | Ala-Thr-Lys-Pro-Gln-Tyr | 692 |
| Ala-Thr-Lys-Pro-Gln-His | Ala-Thr-Lys-Pro-Gln-His | Ala-Thr-Lys-Pro-Gln-His | 693 |
| Ala-Thr-Lys-Pro-Gln-Pro | Ala-Thr-Lys-Pro-Gln-Pro | Ala-Thr-Lys-Pro-Gln-Pro | 694 |
| Ala-Thr-Lys-Pro-Gln-Lys | Ala-Thr-Lys-Pro-Gln-Lys | Ala-Thr-Lys-Pro-Gln-Lys | 695 |
| Ala-Thr-Lys-Pro-Asn | Ala-Thr-Lys-Pro-Asn | Ala-Thr-Lys-Pro-Asn | 696 |
| Ala-Thr-Lys-Pro-Asn-Arg | Ala-Thr-Lys-Pro-Asn-Arg | Ala-Thr-Lys-Pro-Asn-Arg | 697 |
| Ala-Thr-Lys-Pro-Asn-Phe | Ala-Thr-Lys-Pro-Asn-Phe | Ala-Thr-Lys-Pro-Asn-Phe | 698 |
| Ala-Thr-Lys-Pro-Asn-Tyr | Ala-Thr-Lys-Pro-Asn-Tyr | Ala-Thr-Lys-Pro-Asn-Tyr | 699 |
| Ala-Thr-Lys-Pro-Asn-His | Ala-Thr-Lys-Pro-Asn-His | Ala-Thr-Lys-Pro-Asn-His | 700 |
| Ala-Thr-Lys-Pro-Asn-Pro | Ala-Thr-Lys-Pro-Asn-Pro | Ala-Thr-Lys-Pro-Asn-Pro | 701 |
| Ala-Thr-Lys-Pro-Asn-Lys | Ala-Thr-Lys-Pro-Asn-Lys | Ala-Thr-Lys-Pro-Asn-Lys | 702 |
| Ala-Thr-Lys-Pro-Tyr | Ala-Thr-Lys-Pro-Tyr | Ala-Thr-Lys-Pro-Tyr | 703 |
| Ala-Thr-Lys-Pro-Tyr-Arg | Ala-Thr-Lys-Pro-Tyr-Arg | Ala-Thr-Lys-Pro-Tyr-Arg | 704 |
| Ala-Thr-Lys-Pro-Tyr-Phe | Ala-Thr-Lys-Pro-Tyr-Phe | Ala-Thr-Lys-Pro-Tyr-Phe | 705 |
| Ala-Thr-Lys-Pro-Tyr-Tyr | Ala-Thr-Lys-Pro-Tyr-Tyr | Ala-Thr-Lys-Pro-Tyr-Tyr | 706 |
| Ala-Thr-Lys-Pro-Tyr-His | Ala-Thr-Lys-Pro-Tyr-His | Ala-Thr-Lys-Pro-Tyr-His | 707 |
| Ala-Thr-Lys-Pro-Tyr-Pro | Ala-Thr-Lys-Pro-Tyr-Pro | Ala-Thr-Lys-Pro-Tyr-Pro | 708 |
| Ala-Thr-Lys-Pro-Tyr-Lys | Ala-Thr-Lys-Pro-Tyr-Lys | Ala-Thr-Lys-Pro-Tyr-Lys | 709 |
| Ala-Thr-Lys-Pro-Arg | Ala-Thr-Lys-Pro-Arg | Ala-Thr-Lys-Pro-Arg | 710 |
| Ala-Thr-Lys-Pro-Arg-Arg | Ala-Thr-Lys-Pro-Arg-Arg | Ala-Thr-Lys-Pro-Arg-Arg | 711 |

TABLE 1-continued

| X-OH | X-OCH₃ | X-NH₂ | SEQ ID NO |
|---|---|---|---|
| Ala-Thr-Lys-Pro-Arg-Phe | Ala-Thr-Lys-Pro-Arg-Phe | Ala-Thr-Lys-Pro-Arg-Phe | 712 |
| Ala-Thr-Lys-Pro-Arg-Tyr | Ala-Thr-Lys-Pro-Arg-Tyr | Ala-Thr-Lys-Pro-Arg-Tyr | 713 |
| Ala-Thr-Lys-Pro-Arg-His | Ala-Thr-Lys-Pro-Arg-His | Ala-Thr-Lys-Pro-Arg-His | 714 |
| Ala-Thr-Lys-Pro-Arg-Pro | Ala-Thr-Lys-Pro-Arg-Pro | Ala-Thr-Lys-Pro-Arg-Pro | 715 |
| Ala-Thr-Lys-Pro-Arg-Lys | Ala-Thr-Lys-Pro-Arg-Lys | Ala-Thr-Lys-Pro-Arg-Lys | 716 |
| His-Thr-Lys-Pro-Arg | His-Thr-Lys-Pro-Arg | His-Thr-Lys-Pro-Arg | 717 |
| His-Thr-Lys-Pro-Phe | His-Thr-Lys-Pro-Phe | His-Thr-Lys-Pro-Phe | 718 |
| His-Thr-Lys-Pro-Tyr | His-Thr-Lys-Pro-Tyr | His-Thr-Lys-Pro-Tyr | 719 |
| His-Thr-Lys-Pro-Gly | His-Thr-Lys-Pro-Gly | His-Thr-Lys-Pro-Gly | 720 |
| His-Thr-Lys-Pro-His | His-Thr-Lys-Pro-His | His-Thr-Lys-Pro-His | 721 |
| His-Thr-Lys-Pro-Lys | His-Thr-Lys-Pro-Lys | His-Thr-Lys-Pro-Lys | 722 |
| His-Thr-Lys-Pro-Gly | His-Thr-Lys-Pro-Gly | His-Thr-Lys-Pro-Gly | 723 |
| His-Thr-Lys-Pro-Gly-Arg | His-Thr-Lys-Pro-Gly-Arg | His-Thr-Lys-Pro-Gly-Arg | 724 |
| His-Thr-Lys-Pro-Gly-Phe | His-Thr-Lys-Pro-Gly-Phe | His-Thr-Lys-Pro-Gly-Phe | 725 |
| His-Thr-Lys-Pro-Gly-Tyr | His-Thr-Lys-Pro-Gly-Tyr | His-Thr-Lys-Pro-Gly-Tyr | 726 |
| His-Thr-Lys-Pro-Gly-His | His-Thr-Lys-Pro-Gly-His | His-Thr-Lys-Pro-Gly-His | 727 |
| His-Thr-Lys-Pro-Gly-Pro | His-Thr-Lys-Pro-Gly-Pro | His-Thr-Lys-Pro-Gly-Pro | 728 |
| His-Thr-Lys-Pro-Gly-Lys | His-Thr-Lys-Pro-Gly-Lys | His-Thr-Lys-Pro-Gly-Lys | 729 |
| His-Thr-Lys-Pro-Asp | His-Thr-Lys-Pro-Asp | His-Thr-Lys-Pro-Asp | 730 |
| His-Thr-Lys-Pro-Asp-Arg | His-Thr-Lys-Pro-Asp-Arg | His-Thr-Lys-Pro-Asp-Arg | 731 |
| His-Thr-Lys-Pro-Asp-Phe | His-Thr-Lys-Pro-Asp-Phe | His-Thr-Lys-Pro-Asp-Phe | 732 |
| His-Thr-Lys-Pro-Asp-Tyr | His-Thr-Lys-Pro-Asp-Tyr | His-Thr-Lys-Pro-Asp-Tyr | 733 |
| His-Thr-Lys-Pro-Asp-His | His-Thr-Lys-Pro-Asp-His | His-Thr-Lys-Pro-Asp-His | 734 |
| His-Thr-Lys-Pro-Asp-Pro | His-Thr-Lys-Pro-Asp-Pro | His-Thr-Lys-Pro-Asp-Pro | 735 |
| His-Thr-Lys-Pro-Asp-Lys | His-Thr-Lys-Pro-Asp-Lys | His-Thr-Lys-Pro-Asp-Lys | 736 |
| His-Thr-Lys-Pro-Trp | His-Thr-Lys-Pro-Trp | His-Thr-Lys-Pro-Trp | 737 |
| His-Thr-Lys-Pro-Trp-Arg | His-Thr-Lys-Pro-Trp-Arg | His-Thr-Lys-Pro-Trp-Arg | 738 |
| His-Thr-Lys-Pro-Trp-Phe | His-Thr-Lys-Pro-Trp-Phe | His-Thr-Lys-Pro-Trp-Phe | 739 |
| His-Thr-Lys-Pro-Trp-Tyr | His-Thr-Lys-Pro-Trp-Tyr | His-Thr-Lys-Pro-Trp-Tyr | 740 |
| His-Thr-Lys-Pro-Trp-His | His-Thr-Lys-Pro-Trp-His | His-Thr-Lys-Pro-Trp-His | 741 |
| His-Thr-Lys-Pro-Trp-Pro | His-Thr-Lys-Pro-Trp-Pro | His-Thr-Lys-Pro-Trp-Pro | 742 |
| His-Thr-Lys-Pro-Trp-Lys | His-Thr-Lys-Pro-Trp-Lys | His-Thr-Lys-Pro-Trp-Lys | 743 |
| His-Thr-Lys-Pro-Gln | His-Thr-Lys-Pro-Gln | His-Thr-Lys-Pro-Gln | 744 |
| His-Thr-Lys-Pro-Gln-Arg | His-Thr-Lys-Pro-Gln-Arg | His-Thr-Lys-Pro-Gln-Arg | 745 |
| His-Thr-Lys-Pro-Gln-Phe | His-Thr-Lys-Pro-Gln-Phe | His-Thr-Lys-Pro-Gln-Phe | 746 |
| His-Thr-Lys-Pro-Gln-Tyr | His-Thr-Lys-Pro-Gln-Tyr | His-Thr-Lys-Pro-Gln-Tyr | 747 |
| His-Thr-Lys-Pro-Gln-His | His-Thr-Lys-Pro-Gln-His | His-Thr-Lys-Pro-Gln-His | 748 |
| His-Thr-Lys-Pro-Gln-Pro | His-Thr-Lys-Pro-Gln-Pro | His-Thr-Lys-Pro-Gln-Pro | 749 |

TABLE 1-continued

| X-OH | X-OCH₃ | X-NH₂ | SEQ ID NO |
|---|---|---|---|
| His-Thr-Lys-Pro-Gln-Lys | His-Thr-Lys-Pro-Gln-Lys | His-Thr-Lys-Pro-Gln-Lys | 750 |
| His-Thr-Lys-Pro-Asn | His-Thr-Lys-Pro-Asn | His-Thr-Lys-Pro-Asn | 751 |
| His-Thr-Lys-Pro-Asn-Arg | His-Thr-Lys-Pro-Asn-Arg | His-Thr-Lys-Pro-Asn-Arg | 752 |
| His-Thr-Lys-Pro-Asn-Phe | His-Thr-Lys-Pro-Asn-Phe | His-Thr-Lys-Pro-Asn-Phe | 753 |
| His-Thr-Lys-Pro-Asn-Tyr | His-Thr-Lys-Pro-Asn-Tyr | His-Thr-Lys-Pro-Asn-Tyr | 754 |
| His-Thr-Lys-Pro-Asn-His | His-Thr-Lys-Pro-Asn-His | His-Thr-Lys-Pro-Asn-His | 755 |
| His-Thr-Lys-Pro-Asn-Pro | His-Thr-Lys-Pro-Asn-Pro | His-Thr-Lys-Pro-Asn-Pro | 756 |
| His-Thr-Lys-Pro-Asn-Lys | His-Thr-Lys-Pro-Asn-Lys | His-Thr-Lys-Pro-Asn-Lys | 757 |
| His-Thr-Lys-Pro-Tyr | His-Thr-Lys-Pro-Tyr | His-Thr-Lys-Pro-Tyr | 758 |
| His-Thr-Lys-Pro-Tyr-Arg | His-Thr-Lys-Pro-Tyr-Arg | His-Thr-Lys-Pro-Tyr-Arg | 759 |
| His-Thr-Lys-Pro-Tyr-Phe | His-Thr-Lys-Pro-Tyr-Phe | His-Thr-Lys-Pro-Tyr-Phe | 760 |
| His-Thr-Lys-Pro-Tyr-Tyr | His-Thr-Lys-Pro-Tyr-Tyr | His-Thr-Lys-Pro-Tyr-Tyr | 761 |
| His-Thr-Lys-Pro-Tyr-His | His-Thr-Lys-Pro-Tyr-His | His-Thr-Lys-Pro-Tyr-His | 762 |
| His-Thr-Lys-Pro-Tyr-Pro | His-Thr-Lys-Pro-Tyr-Pro | His-Thr-Lys-Pro-Tyr-Pro | 763 |
| His-Thr-Lys-Pro-Tyr-Lys | His-Thr-Lys-Pro-Tyr-Lys | His-Thr-Lys-Pro-Tyr-Lys | 764 |
| His-Thr-Lys-Pro-Arg | His-Thr-Lys-Pro-Arg | His-Thr-Lys-Pro-Arg | 765 |
| His-Thr-Lys-Pro-Arg-Arg | His-Thr-Lys-Pro-Arg-Arg | His-Thr-Lys-Pro-Arg-Arg | 766 |
| His-Thr-Lys-Pro-Arg-Phe | His-Thr-Lys-Pro-Arg-Phe | His-Thr-Lys-Pro-Arg-Phe | 767 |
| His-Thr-Lys-Pro-Arg-Tyr | His-Thr-Lys-Pro-Arg-Tyr | His-Thr-Lys-Pro-Arg-Tyr | 768 |
| His-Thr-Lys-Pro-Arg-His | His-Thr-Lys-Pro-Arg-His | His-Thr-Lys-Pro-Arg-His | 769 |
| His-Thr-Lys-Pro-Arg-Pro | His-Thr-Lys-Pro-Arg-Pro | His-Thr-Lys-Pro-Arg-Pro | 770 |
| His-Thr-Lys-Pro-Arg-Lys | His-Thr-Lys-Pro-Arg-Lys | His-Thr-Lys-Pro-Arg-Lys | 771 |
| Lys-Thr-Lys-Pro-Arg | Lys-Thr-Lys-Pro-Arg | Lys-Thr-Lys-Pro-Arg | 772 |
| Lys-Thr-Lys-Pro-Phe | Lys-Thr-Lys-Pro-Phe | Lys-Thr-Lys-Pro-Phe | 773 |
| Lys-Thr-Lys-Pro-Tyr | Lys-Thr-Lys-Pro-Tyr | Lys-Thr-Lys-Pro-Tyr | 774 |
| Lys-Thr-Lys-Pro-Gly | Lys-Thr-Lys-Pro-Gly | Lys-Thr-Lys-Pro-Gly | 775 |
| Lys-Thr-Lys-Pro-His | Lys-Thr-Lys-Pro-His | Lys-Thr-Lys-Pro-His | 776 |
| Lys-Thr-Lys-Pro-Lys | Lys-Thr-Lys-Pro-Lys | Lys-Thr-Lys-Pro-Lys | 777 |
| Lys-Thr-Lys-Pro-Gly | Lys-Thr-Lys-Pro-Gly | Lys-Thr-Lys-Pro-Gly | 778 |
| Lys-Thr-Lys-Pro-Gly-Arg | Lys-Thr-Lys-Pro-Gly-Arg | Lys-Thr-Lys-Pro-Gly-Arg | 779 |
| Lys-Thr-Lys-Pro-Gly-Phe | Lys-Thr-Lys-Pro-Gly-Phe | Lys-Thr-Lys-Pro-Gly-Phe | 780 |
| Lys-Thr-Lys-Pro-Gly-Tyr | Lys-Thr-Lys-Pro-Gly-Tyr | Lys-Thr-Lys-Pro-Gly-Tyr | 781 |
| Lys-Thr-Lys-Pro-Gly-His | Lys-Thr-Lys-Pro-Gly-His | Lys-Thr-Lys-Pro-Gly-His | 782 |
| Lys-Thr-Lys-Pro-Gly-Pro | Lys-Thr-Lys-Pro-Gly-Pro | Lys-Thr-Lys-Pro-Gly-Pro | 783 |
| Lys-Thr-Lys-Pro-Gly-Lys | Lys-Thr-Lys-Pro-Gly-Lys | Lys-Thr-Lys-Pro-Gly-Lys | 784 |
| Lys-Thr-Lys-Pro-Asp | Lys-Thr-Lys-Pro-Asp | Lys-Thr-Lys-Pro-Asp | 785 |
| Lys-Thr-Lys-Pro-Asp-Arg | Lys-Thr-Lys-Pro-Asp-Arg | Lys-Thr-Lys-Pro-Asp-Arg | 786 |
| Lys-Thr-Lys-Pro-Asp-Phe | Lys-Thr-Lys-Pro-Asp-Phe | Lys-Thr-Lys-Pro-Asp-Phe | 787 |

TABLE 1-continued

| X-OH | X-OCH₃ | X-NH₂ | SEQ ID NO |
|---|---|---|---|
| Lys-Thr-Lys-Pro-Asp-Tyr | Lys-Thr-Lys-Pro-Asp-Tyr | Lys-Thr-Lys-Pro-Asp-Tyr | 788 |
| Lys-Thr-Lys-Pro-Asp-His | Lys-Thr-Lys-Pro-Asp-His | Lys-Thr-Lys-Pro-Asp-His | 789 |
| Lys-Thr-Lys-Pro-Asp-Pro | Lys-Thr-Lys-Pro-Asp-Pro | Lys-Thr-Lys-Pro-Asp-Pro | 790 |
| Lys-Thr-Lys-Pro-Asp-Lys | Lys-Thr-Lys-Pro-Asp-Lys | Lys-Thr-Lys-Pro-Asp-Lys | 791 |
| Lys-Thr-Lys-Pro-Trp | Lys-Thr-Lys-Pro-Trp | Lys-Thr-Lys-Pro-Trp | 792 |
| Lys-Thr-Lys-Pro-Trp-Arg | Lys-Thr-Lys-Pro-Trp-Arg | Lys-Thr-Lys-Pro-Trp-Arg | 793 |
| Lys-Thr-Lys-Pro-Trp-Phe | Lys-Thr-Lys-Pro-Trp-Phe | Lys-Thr-Lys-Pro-Trp-Phe | 794 |
| Lys-Thr-Lys-Pro-Trp-Tyr | Lys-Thr-Lys-Pro-Trp-Tyr | Lys-Thr-Lys-Pro-Trp-Tyr | 795 |
| Lys-Thr-Lys-Pro-Trp-His | Lys-Thr-Lys-Pro-Trp-His | Lys-Thr-Lys-Pro-Trp-His | 796 |
| Lys-Thr-Lys-Pro-Trp-Pro | Lys-Thr-Lys-Pro-Trp-Pro | Lys-Thr-Lys-Pro-Trp-Pro | 797 |
| Lys-Thr-Lys-Pro-Trp-Lys | Lys-Thr-Lys-Pro-Trp-Lys | Lys-Thr-Lys-Pro-Trp-Lys | 798 |
| Lys-Thr-Lys-Pro-Gln | Lys-Thr-Lys-Pro-Gln | Lys-Thr-Lys-Pro-Gln | 799 |
| Lys-Thr-Lys-Pro-Gln-Arg | Lys-Thr-Lys-Pro-Gln-Arg | Lys-Thr-Lys-Pro-Gln-Arg | 800 |
| Lys-Thr-Lys-Pro-Gln-Phe | Lys-Thr-Lys-Pro-Gln-Phe | Lys-Thr-Lys-Pro-Gln-Phe | 801 |
| Lys-Thr-Lys-Pro-Gln-Tyr | Lys-Thr-Lys-Pro-Gln-Tyr | Lys-Thr-Lys-Pro-Gln-Tyr | 802 |
| Lys-Thr-Lys-Pro-Gln-His | Lys-Thr-Lys-Pro-Gln-His | Lys-Thr-Lys-Pro-Gln-His | 803 |
| Lys-Thr-Lys-Pro-Gln-Pro | Lys-Thr-Lys-Pro-Gln-Pro | Lys-Thr-Lys-Pro-Gln-Pro | 804 |
| Lys-Thr-Lys-Pro-Gln-Lys | Lys-Thr-Lys-Pro-Gln-Lys | Lys-Thr-Lys-Pro-Gln-Lys | 805 |
| Lys-Thr-Lys-Pro-Asn | Lys-Thr-Lys-Pro-Asn | Lys-Thr-Lys-Pro-Asn | 806 |
| Lys-Thr-Lys-Pro-Asn-Arg | Lys-Thr-Lys-Pro-Asn-Arg | Lys-Thr-Lys-Pro-Asn-Arg | 807 |
| Lys-Thr-Lys-Pro-Asn-Phe | Lys-Thr-Lys-Pro-Asn-Phe | Lys-Thr-Lys-Pro-Asn-Phe | 808 |
| Lys-Thr-Lys-Pro-Asn-Tyr | Lys-Thr-Lys-Pro-Asn-Tyr | Lys-Thr-Lys-Pro-Asn-Tyr | 809 |
| Lys-Thr-Lys-Pro-Asn-His | Lys-Thr-Lys-Pro-Asn-His | Lys-Thr-Lys-Pro-Asn-His | 810 |
| Lys-Thr-Lys-Pro-Asn-Pro | Lys-Thr-Lys-Pro-Asn-Pro | Lys-Thr-Lys-Pro-Asn-Pro | 811 |
| Lys-Thr-Lys-Pro-Asn-Lys | Lys-Thr-Lys-Pro-Asn-Lys | Lys-Thr-Lys-Pro-Asn-Lys | 812 |
| Lys-Thr-Lys-Pro-Tyr | Lys-Thr-Lys-Pro-Tyr | Lys-Thr-Lys-Pro-Tyr | 813 |
| Lys-Thr-Lys-Pro-Tyr-Arg | Lys-Thr-Lys-Pro-Tyr-Arg | Lys-Thr-Lys-Pro-Tyr-Arg | 814 |
| Lys-Thr-Lys-Pro-Tyr-Phe | Lys-Thr-Lys-Pro-Tyr-Phe | Lys-Thr-Lys-Pro-Tyr-Phe | 815 |
| Lys-Thr-Lys-Pro-Tyr-Tyr | Lys-Thr-Lys-Pro-Tyr-Tyr | Lys-Thr-Lys-Pro-Tyr-Tyr | 816 |
| Lys-Thr-Lys-Pro-Tyr-His | Lys-Thr-Lys-Pro-Tyr-His | Lys-Thr-Lys-Pro-Tyr-His | 817 |
| Lys-Thr-Lys-Pro-Tyr-Pro | Lys-Thr-Lys-Pro-Tyr-Pro | Lys-Thr-Lys-Pro-Tyr-Pro | 818 |
| Lys-Thr-Lys-Pro-Tyr-Lys | Lys-Thr-Lys-Pro-Tyr-Lys | Lys-Thr-Lys-Pro-Tyr-Lys | 819 |
| Lys-Thr-Lys-Pro-Arg | Lys-Thr-Lys-Pro-Arg | Lys-Thr-Lys-Pro-Arg | 820 |
| Lys-Thr-Lys-Pro-Arg-Arg | Lys-Thr-Lys-Pro-Arg-Arg | Lys-Thr-Lys-Pro-Arg-Arg | 821 |
| Lys-Thr-Lys-Pro-Arg-Phe | Lys-Thr-Lys-Pro-Arg-Phe | Lys-Thr-Lys-Pro-Arg-Phe | 822 |
| Lys-Thr-Lys-Pro-Arg-Tyr | Lys-Thr-Lys-Pro-Arg-Tyr | Lys-Thr-Lys-Pro-Arg-Tyr | 823 |
| Lys-Thr-Lys-Pro-Arg-His | Lys-Thr-Lys-Pro-Arg-His | Lys-Thr-Lys-Pro-Arg-His | 824 |
| Lys-Thr-Lys-Pro-Arg-Pro | Lys-Thr-Lys-Pro-Arg-Pro | Lys-Thr-Lys-Pro-Arg-Pro | 825 |

TABLE 1-continued

| X-OH | X-OCH₃ | X-NH₂ | SEQ ID NO |
|---|---|---|---|
| Lys-Thr-Lys-Pro-Arg-Lys | Lys-Thr-Lys-Pro-Arg-Lys | Lys-Thr-Lys-Pro-Arg-Lys | 826 |
| Gly-Thr-Lys-Pro-Arg | Gly-Thr-Lys-Pro-Arg | Gly-Thr-Lys-Pro-Arg | 827 |
| Gly-Thr-Lys-Pro-Phe | Gly-Thr-Lys-Pro-Phe | Gly-Thr-Lys-Pro-Phe | 828 |
| Gly-Thr-Lys-Pro-Tyr | Gly-Thr-Lys-Pro-Tyr | Gly-Thr-Lys-Pro-Tyr | 829 |
| Gly-Thr-Lys-Pro-Gly | Gly-Thr-Lys-Pro-Gly | Gly-Thr-Lys-Pro-Gly | 830 |
| Gly-Thr-Lys-Pro-His | Gly-Thr-Lys-Pro-His | Gly-Thr-Lys-Pro-His | 831 |
| Gly-Thr-Lys-Pro-Lys | Gly-Thr-Lys-Pro-Lys | Gly-Thr-Lys-Pro-Lys | 832 |
| Gly-Thr-Lys-Pro-Gly | Gly-Thr-Lys-Pro-Gly | Gly-Thr-Lys-Pro-Gly | 833 |
| Gly-Thr-Lys-Pro-Gly-Arg | Gly-Thr-Lys-Pro-Gly-Arg | Gly-Thr-Lys-Pro-Gly-Arg | 834 |
| Gly-Thr-Lys-Pro-Gly-Phe | Gly-Thr-Lys-Pro-Gly-Phe | Gly-Thr-Lys-Pro-Gly-Phe | 835 |
| Gly-Thr-Lys-Pro-Gly-Tyr | Gly-Thr-Lys-Pro-Gly-Tyr | Gly-Thr-Lys-Pro-Gly-Tyr | 836 |
| Gly-Thr-Lys-Pro-Gly-His | Gly-Thr-Lys-Pro-Gly-His | Gly-Thr-Lys-Pro-Gly-His | 837 |
| Gly-Thr-Lys-Pro-Gly-Pro | Gly-Thr-Lys-Pro-Gly-Pro | Gly-Thr-Lys-Pro-Gly-Pro | 838 |
| Gly-Thr-Lys-Pro-Gly-Lys | Gly-Thr-Lys-Pro-Gly-Lys | Gly-Thr-Lys-Pro-Gly-Lys | 839 |
| Gly-Thr-Lys-Pro-Asp | Gly-Thr-Lys-Pro-Asp | Gly-Thr-Lys-Pro-Asp | 840 |
| Gly-Thr-Lys-Pro-Asp-Arg | Gly-Thr-Lys-Pro-Asp-Arg | Gly-Thr-Lys-Pro-Asp-Arg | 841 |
| Gly-Thr-Lys-Pro-Asp-Phe | Gly-Thr-Lys-Pro-Asp-Phe | Gly-Thr-Lys-Pro-Asp-Phe | 842 |
| Gly-Thr-Lys-Pro-Asp-Tyr | Gly-Thr-Lys-Pro-Asp-Tyr | Gly-Thr-Lys-Pro-Asp-Tyr | 843 |
| Gly-Thr-Lys-Pro-Asp-His | Gly-Thr-Lys-Pro-Asp-His | Gly-Thr-Lys-Pro-Asp-His | 844 |
| Gly-Thr-Lys-Pro-Asp-Pro | Gly-Thr-Lys-Pro-Asp-Pro | Gly-Thr-Lys-Pro-Asp-Pro | 845 |
| Gly-Thr-Lys-Pro-Asp-Lys | Gly-Thr-Lys-Pro-Asp-Lys | Gly-Thr-Lys-Pro-Asp-Lys | 846 |
| Gly-Thr-Lys-Pro-Trp | Gly-Thr-Lys-Pro-Trp | Gly-Thr-Lys-Pro-Trp | 847 |
| Gly-Thr-Lys-Pro-Trp-Arg | Gly-Thr-Lys-Pro-Trp-Arg | Gly-Thr-Lys-Pro-Trp-Arg | 848 |
| Gly-Thr-Lys-Pro-Trp-Phe | Gly-Thr-Lys-Pro-Trp-Phe | Gly-Thr-Lys-Pro-Trp-Phe | 849 |
| Gly-Thr-Lys-Pro-Trp-Tyr | Gly-Thr-Lys-Pro-Trp-Tyr | Gly-Thr-Lys-Pro-Trp-Tyr | 850 |
| Gly-Thr-Lys-Pro-Trp-His | Gly-Thr-Lys-Pro-Trp-His | Gly-Thr-Lys-Pro-Trp-His | 851 |
| Gly-Thr-Lys-Pro-Trp-Pro | Gly-Thr-Lys-Pro-Trp-Pro | Gly-Thr-Lys-Pro-Trp-Pro | 852 |
| Gly-Thr-Lys-Pro-Trp-Lys | Gly-Thr-Lys-Pro-Trp-Lys | Gly-Thr-Lys-Pro-Trp-Lys | 853 |
| Gly-Thr-Lys-Pro-Gln | Gly-Thr-Lys-Pro-Gln | Gly-Thr-Lys-Pro-Gln | 854 |
| Gly-Thr-Lys-Pro-Gln-Arg | Gly-Thr-Lys-Pro-Gln-Arg | Gly-Thr-Lys-Pro-Gln-Arg | 855 |
| Gly-Thr-Lys-Pro-Gln-Phe | Gly-Thr-Lys-Pro-Gln-Phe | Gly-Thr-Lys-Pro-Gln-Phe | 856 |
| Gly-Thr-Lys-Pro-Gln-Tyr | Gly-Thr-Lys-Pro-Gln-Tyr | Gly-Thr-Lys-Pro-Gln-Tyr | 857 |
| Gly-Thr-Lys-Pro-Gln-His | Gly-Thr-Lys-Pro-Gln-His | Gly-Thr-Lys-Pro-Gln-His | 858 |
| Gly-Thr-Lys-Pro-Gln-Pro | Gly-Thr-Lys-Pro-Gln-Pro | Gly-Thr-Lys-Pro-Gln-Pro | 859 |
| Gly-Thr-Lys-Pro-Gln-Lys | Gly-Thr-Lys-Pro-Gln-Lys | Gly-Thr-Lys-Pro-Gln-Lys | 860 |
| Gly-Thr-Lys-Pro-Asn | Gly-Thr-Lys-Pro-Asn | Gly-Thr-Lys-Pro-Asn | 861 |
| Gly-Thr-Lys-Pro-Asn-Arg | Gly-Thr-Lys-Pro-Asn-Arg | Gly-Thr-Lys-Pro-Asn-Arg | 862 |
| Gly-Thr-Lys-Pro-Asn-Phe | Gly-Thr-Lys-Pro-Asn-Phe | Gly-Thr-Lys-Pro-Asn-Phe | 863 |

TABLE 1-continued

| X-OH | X-OCH₃ | X-NH₂ | SEQ ID NO |
|---|---|---|---|
| Gly-Thr-Lys-Pro-Asn-Tyr | Gly-Thr-Lys-Pro-Asn-Tyr | Gly-Thr-Lys-Pro-Asn-Tyr | 864 |
| Gly-Thr-Lys-Pro-Asn-His | Gly-Thr-Lys-Pro-Asn-His | Gly-Thr-Lys-Pro-Asn-His | 865 |
| Gly-Thr-Lys-Pro-Asn-Pro | Gly-Thr-Lys-Pro-Asn-Pro | Gly-Thr-Lys-Pro-Asn-Pro | 866 |
| Gly-Thr-Lys-Pro-Asn-Lys | Gly-Thr-Lys-Pro-Asn-Lys | Gly-Thr-Lys-Pro-Asn-Lys | 867 |
| Gly-Thr-Lys-Pro-Tyr | Gly-Thr-Lys-Pro-Tyr | Gly-Thr-Lys-Pro-Tyr | 868 |
| Gly-Thr-Lys-Pro-Tyr-Arg | Gly-Thr-Lys-Pro-Tyr-Arg | Gly-Thr-Lys-Pro-Tyr-Arg | 869 |
| Gly-Thr-Lys-Pro-Tyr-Phe | Gly-Thr-Lys-Pro-Tyr-Phe | Gly-Thr-Lys-Pro-Tyr-Phe | 870 |
| Gly-Thr-Lys-Pro-Tyr-Tyr | Gly-Thr-Lys-Pro-Tyr-Tyr | Gly-Thr-Lys-Pro-Tyr-Tyr | 871 |
| Gly-Thr-Lys-Pro-Tyr-His | Gly-Thr-Lys-Pro-Tyr-His | Gly-Thr-Lys-Pro-Tyr-His | 872 |
| Gly-Thr-Lys-Pro-Tyr-Pro | Gly-Thr-Lys-Pro-Tyr-Pro | Gly-Thr-Lys-Pro-Tyr-Pro | 873 |
| Gly-Thr-Lys-Pro-Tyr-Lys | Gly-Thr-Lys-Pro-Tyr-Lys | Gly-Thr-Lys-Pro-Tyr-Lys | 874 |
| Gly-Thr-Lys-Pro-Arg | Gly-Thr-Lys-Pro-Arg | Gly-Thr-Lys-Pro-Arg | 875 |
| Gly-Thr-Lys-Pro-Arg-Arg | Gly-Thr-Lys-Pro-Arg-Arg | Gly-Thr-Lys-Pro-Arg-Arg | 876 |
| Gly-Thr-Lys-Pro-Arg-Phe | Gly-Thr-Lys-Pro-Arg-Phe | Gly-Thr-Lys-Pro-Arg-Phe | 877 |
| Gly-Thr-Lys-Pro-Arg-Tyr | Gly-Thr-Lys-Pro-Arg-Tyr | Gly-Thr-Lys-Pro-Arg-Tyr | 878 |
| Gly-Thr-Lys-Pro-Arg-His | Gly-Thr-Lys-Pro-Arg-His | Gly-Thr-Lys-Pro-Arg-His | 879 |
| Gly-Thr-Lys-Pro-Arg-Pro | Gly-Thr-Lys-Pro-Arg-Pro | Gly-Thr-Lys-Pro-Arg-Pro | 880 |
| Gly-Thr-Lys-Pro-Arg-Lys | Gly-Thr-Lys-Pro-Arg-Lys | Gly-Thr-Lys-Pro-Arg-Lys | 881 |
| Thr-Lys-Pro-Arg-Val | Thr-Lys-Pro-Arg-Val | Thr-Lys-Pro-Arg-Val | 882 |
| Thr-Lys-Pro-Phe-Val | Thr-Lys-Pro-Phe-Val | Thr-Lys-Pro-Phe-Val | 883 |
| Thr-Lys-Pro-Tyr-Val | Thr-Lys-Pro-Tyr-Val | Thr-Lys-Pro-Tyr-Val | 884 |
| Thr-Lys-Pro-Gly-Val | Thr-Lys-Pro-Gly-Val | Thr-Lys-Pro-Gly-Val | 885 |
| Thr-Lys-Pro-His-Val | Thr-Lys-Pro-His-Val | Thr-Lys-Pro-His-Val | 886 |
| Thr-Lys-Pro-Lys-Val | Thr-Lys-Pro-Lys-Val | Thr-Lys-Pro-Lys-Val | 887 |
| Thr-Lys-Pro-Gly-Val | Thr-Lys-Pro-Gly-Val | Thr-Lys-Pro-Gly-Val | 888 |
| Thr-Lys-Pro-Gly-Arg-Val | Thr-Lys-Pro-Gly-Arg-Val | Thr-Lys-Pro-Gly-Arg-Val | 889 |
| Thr-Lys-Pro-Gly-Phe-Val | Thr-Lys-Pro-Gly-Phe-Val | Thr-Lys-Pro-Gly-Phe-Val | 890 |
| Thr-Lys-Pro-Gly-Tyr-Val | Thr-Lys-Pro-Gly-Tyr-Val | Thr-Lys-Pro-Gly-Tyr-Val | 891 |
| Thr-Lys-Pro-Gly-His-Val | Thr-Lys-Pro-Gly-His-Val | Thr-Lys-Pro-Gly-His-Val | 892 |
| Thr-Lys-Pro-Gly-Pro-Val | Thr-Lys-Pro-Gly-Pro-Val | Thr-Lys-Pro-Gly-Pro-Val | 893 |
| Thr-Lys-Pro-Gly-Lys-Val | Thr-Lys-Pro-Gly-Lys-Val | Thr-Lys-Pro-Gly-Lys-Val | 894 |
| Thr-Lys-Pro-Asp-Val | Thr-Lys-Pro-Asp-Val | Thr-Lys-Pro-Asp-Val | 895 |
| Thr-Lys-Pro-Asp-Arg-Val | Thr-Lys-Pro-Asp-Arg-Val | Thr-Lys-Pro-Asp-Arg-Val | 896 |
| Thr-Lys-Pro-Asp-Phe-Val | Thr-Lys-Pro-Asp-Phe-Val | Thr-Lys-Pro-Asp-Phe-Val | 897 |
| Thr-Lys-Pro-Asp-Tyr-Val | Thr-Lys-Pro-Asp-Tyr-Val | Thr-Lys-Pro-Asp-Tyr-Val | 898 |
| Thr-Lys-Pro-Asp-His-Val | Thr-Lys-Pro-Asp-His-Val | Thr-Lys-Pro-Asp-His-Val | 899 |
| Thr-Lys-Pro-Asp-Pro-Val | Thr-Lys-Pro-Asp-Pro-Val | Thr-Lys-Pro-Asp-Pro-Val | 900 |
| Thr-Lys-Pro-Asp-Lys-Val | Thr-Lys-Pro-Asp-Lys-Val | Thr-Lys-Pro-Asp-Lys-Val | 901 |

TABLE 1-continued

| X-OH | X-OCH₃ | X-NH₂ | SEQ ID NO |
|---|---|---|---|
| Thr-Lys-Pro-Trp-Val | Thr-Lys-Pro-Trp-Val | Thr-Lys-Pro-Trp-Val | 902 |
| Thr-Lys-Pro-Trp-Arg-Val | Thr-Lys-Pro-Trp-Arg-Val | Thr-Lys-Pro-Trp-Arg-Val | 903 |
| Thr-Lys-Pro-Trp-Phe-Val | Thr-Lys-Pro-Trp-Phe-Val | Thr-Lys-Pro-Trp-Phe-Val | 904 |
| Thr-Lys-Pro-Trp-Tyr-Val | Thr-Lys-Pro-Trp-Tyr-Val | Thr-Lys-Pro-Trp-Tyr-Val | 905 |
| Thr-Lys-Pro-Trp-His-Val | Thr-Lys-Pro-Trp-His-Val | Thr-Lys-Pro-Trp-His-Val | 906 |
| Thr-Lys-Pro-Trp-Pro-Val | Thr-Lys-Pro-Trp-Pro-Val | Thr-Lys-Pro-Trp-Pro-Val | 907 |
| Thr-Lys-Pro-Trp-Lys-Val | Thr-Lys-Pro-Trp-Lys-Val | Thr-Lys-Pro-Trp-Lys-Val | 908 |
| Thr-Lys-Pro-Gln-Val | Thr-Lys-Pro-Gln-Val | Thr-Lys-Pro-Gln-Val | 909 |
| Thr-Lys-Pro-Gln-Arg-Val | Thr-Lys-Pro-Gln-Arg-Val | Thr-Lys-Pro-Gln-Arg-Val | 910 |
| Thr-Lys-Pro-Gln-Phe-Val | Thr-Lys-Pro-Gln-Phe-Val | Thr-Lys-Pro-Gln-Phe-Val | 911 |
| Thr-Lys-Pro-Gln-Tyr-Val | Thr-Lys-Pro-Gln-Tyr-Val | Thr-Lys-Pro-Gln-Tyr-Val | 912 |
| Thr-Lys-Pro-Gln-His-Val | Thr-Lys-Pro-Gln-His-Val | Thr-Lys-Pro-Gln-His-Val | 913 |
| Thr-Lys-Pro-Gln-Pro-Val | Thr-Lys-Pro-Gln-Pro-Val | Thr-Lys-Pro-Gln-Pro-Val | 914 |
| Thr-Lys-Pro-Gln-Lys-Val | Thr-Lys-Pro-Gln-Lys-Val | Thr-Lys-Pro-Gln-Lys-Val | 915 |
| Thr-Lys-Pro-Asn-Val | Thr-Lys-Pro-Asn-Val | Thr-Lys-Pro-Asn-Val | 916 |
| Thr-Lys-Pro-Asn-Arg-Val | Thr-Lys-Pro-Asn-Arg-Val | Thr-Lys-Pro-Asn-Arg-Val | 917 |
| Thr-Lys-Pro-Asn-Phe-Val | Thr-Lys-Pro-Asn-Phe-Val | Thr-Lys-Pro-Asn-Phe-Val | 918 |
| Thr-Lys-Pro-Asn-Tyr-Val | Thr-Lys-Pro-Asn-Tyr-Val | Thr-Lys-Pro-Asn-Tyr-Val | 919 |
| Thr-Lys-Pro-Asn-His-Val | Thr-Lys-Pro-Asn-His-Val | Thr-Lys-Pro-Asn-His-Val | 920 |
| Thr-Lys-Pro-Asn-Pro-Val | Thr-Lys-Pro-Asn-Pro-Val | Thr-Lys-Pro-Asn-Pro-Val | 921 |
| Thr-Lys-Pro-Asn-Lys-Val | Thr-Lys-Pro-Asn-Lys-Val | Thr-Lys-Pro-Asn-Lys-Val | 922 |
| Thr-Lys-Pro-Tyr-Val | Thr-Lys-Pro-Tyr-Val | Thr-Lys-Pro-Tyr-Val | 923 |
| Thr-Lys-Pro-Tyr-Arg-Val | Thr-Lys-Pro-Tyr-Arg-Val | Thr-Lys-Pro-Tyr-Arg-Val | 924 |
| Thr-Lys-Pro-Tyr-Phe-Val | Thr-Lys-Pro-Tyr-Phe-Val | Thr-Lys-Pro-Tyr-Phe-Val | 925 |
| Thr-Lys-Pro-Tyr-Tyr-Val | Thr-Lys-Pro-Tyr-Tyr-Val | Thr-Lys-Pro-Tyr-Tyr-Val | 926 |
| Thr-Lys-Pro-Tyr-His-Val | Thr-Lys-Pro-Tyr-His-Val | Thr-Lys-Pro-Tyr-His-Val | 927 |
| Thr-Lys-Pro-Tyr-Pro-Val | Thr-Lys-Pro-Tyr-Pro-Val | Thr-Lys-Pro-Tyr-Pro-Val | 928 |
| Thr-Lys-Pro-Tyr-Lys-Val | Thr-Lys-Pro-Tyr-Lys-Val | Thr-Lys-Pro-Tyr-Lys-Val | 929 |
| Thr-Lys-Pro-Arg-Val | Thr-Lys-Pro-Arg-Val | Thr-Lys-Pro-Arg-Val | 930 |
| Thr-Lys-Pro-Arg-Arg-Val | Thr-Lys-Pro-Arg-Arg-Val | Thr-Lys-Pro-Arg-Arg-Val | 931 |
| Thr-Lys-Pro-Arg-Phe-Val | Thr-Lys-Pro-Arg-Phe-Val | Thr-Lys-Pro-Arg-Phe-Val | 932 |
| Thr-Lys-Pro-Arg-Tyr-Val | Thr-Lys-Pro-Arg-Tyr-Val | Thr-Lys-Pro-Arg-Tyr-Val | 933 |
| Thr-Lys-Pro-Arg-His-Val | Thr-Lys-Pro-Arg-His-Val | Thr-Lys-Pro-Arg-His-Val | 934 |
| Thr-Lys-Pro-Arg-Pro-Val | Thr-Lys-Pro-Arg-Pro-Val | Thr-Lys-Pro-Arg-Pro-Val | 935 |
| Thr-Lys-Pro-Arg-Lys-Val | Thr-Lys-Pro-Arg-Lys-Val | Thr-Lys-Pro-Arg-Lys-Val | 936 |
| Met-Thr-Lys-Pro-Val | Met-Thr-Lys-Pro-Val | Met-Thr-Lys-Pro-Val | 937 |
| Met-Thr-Lys-Pro-Arg-Val | Met-Thr-Lys-Pro-Arg-Val | Met-Thr-Lys-Pro-Arg-Val | 938 |
| Met-Thr-Lys-Pro-Phe-Val | Met-Thr-Lys-Pro-Phe-Val | Met-Thr-Lys-Pro-Phe-Val | 939 |

TABLE 1-continued

| X-OH | X-OCH₃ | X-NH₂ | SEQ ID NO |
|---|---|---|---|
| Met-Thr-Lys-Pro-Tyr-Val | Met-Thr-Lys-Pro-Tyr-Val | Met-Thr-Lys-Pro-Tyr-Val | 940 |
| Met-Thr-Lys-Pro-His-Val | Met-Thr-Lys-Pro-His-Val | Met-Thr-Lys-Pro-His-Val | 941 |
| Met-Thr-Lys-Pro-Lys-Val | Met-Thr-Lys-Pro-Lys-Val | Met-Thr-Lys-Pro-Lys-Val | 942 |
| Met-Thr-Lys-Pro-Gly-Val | Met-Thr-Lys-Pro-Gly-Val | Met-Thr-Lys-Pro-Gly-Val | 943 |
| Met-Thr-Lys-Pro-Gly-Arg-Val | Met-Thr-Lys-Pro-Gly-Arg-Val | Met-Thr-Lys-Pro-Gly-Arg-Val | 944 |
| Met-Thr-Lys-Pro-Gly-Phe-Val | Met-Thr-Lys-Pro-Gly-Phe-Val | Met-Thr-Lys-Pro-Gly-Phe-Val | 945 |
| Met-Thr-Lys-Pro-Gly-Tyr-Val | Met-Thr-Lys-Pro-Gly-Tyr-Val | Met-Thr-Lys-Pro-Gly-Tyr-Val | 946 |
| Met-Thr-Lys-Pro-Gly-His-Val | Met-Thr-Lys-Pro-Gly-His-Val | Met-Thr-Lys-Pro-Gly-His-Val | 947 |
| Met-Thr-Lys-Pro-Gly-Pro-Val | Met-Thr-Lys-Pro-Gly-Pro-Val | Met-Thr-Lys-Pro-Gly-Pro-Val | 948 |
| Met-Thr-Lys-Pro-Gly-Lys-Val | Met-Thr-Lys-Pro-Gly-Lys-Val | Met-Thr-Lys-Pro-Gly-Lys-Val | 949 |
| Met-Thr-Lys-Pro-Asp-Val | Met-Thr-Lys-Pro-Asp-Val | Met-Thr-Lys-Pro-Asp-Val | 950 |
| Met-Thr-Lys-Pro-Asp-Arg-Val | Met-Thr-Lys-Pro-Asp-Arg-Val | Met-Thr-Lys-Pro-Asp-Arg-Val | 951 |
| Met-Thr-Lys-Pro-Asp-Phe-Val | Met-Thr-Lys-Pro-Asp-Phe-Val | Met-Thr-Lys-Pro-Asp-Phe-Val | 952 |
| Met-Thr-Lys-Pro-Asp-Tyr-Val | Met-Thr-Lys-Pro-Asp-Tyr-Val | Met-Thr-Lys-Pro-Asp-Tyr-Val | 953 |
| Met-Thr-Lys-Pro-Asp-His-Val | Met-Thr-Lys-Pro-Asp-His-Val | Met-Thr-Lys-Pro-Asp-His-Val | 954 |
| Met-Thr-Lys-Pro-Asp-Pro-Val | Met-Thr-Lys-Pro-Asp-Pro-Val | Met-Thr-Lys-Pro-Asp-Pro-Val | 955 |
| Met-Thr-Lys-Pro-Asp-Lys-Val | Met-Thr-Lys-Pro-Asp-Lys-Val | Met-Thr-Lys-Pro-Asp-Lys-Val | 956 |
| Met-Thr-Lys-Pro-Trp-Val | Met-Thr-Lys-Pro-Trp-Val | Met-Thr-Lys-Pro-Trp-Val | 957 |
| Met-Thr-Lys-Pro-Trp-Arg-Val | Met-Thr-Lys-Pro-Trp-Arg-Val | Met-Thr-Lys-Pro-Trp-Arg-Val | 958 |
| Met-Thr-Lys-Pro-Trp-Phe-Val | Met-Thr-Lys-Pro-Trp-Phe-Val | Met-Thr-Lys-Pro-Trp-Phe-Val | 959 |
| Met-Thr-Lys-Pro-Trp-Tyr-Val | Met-Thr-Lys-Pro-Trp-Tyr-Val | Met-Thr-Lys-Pro-Trp-Tyr-Val | 960 |
| Met-Thr-Lys-Pro-Trp-His-Val | Met-Thr-Lys-Pro-Trp-His-Val | Met-Thr-Lys-Pro-Trp-His-Val | 961 |
| Met-Thr-Lys-Pro-Trp-Pro-Val | Met-Thr-Lys-Pro-Trp-Pro-Val | Met-Thr-Lys-Pro-Trp-Pro-Val | 962 |
| Met-Thr-Lys-Pro-Trp-Lys-Val | Met-Thr-Lys-Pro-Trp-Lys-Val | Met-Thr-Lys-Pro-Trp-Lys-Val | 963 |
| Met-Thr-Lys-Pro-Gln-Val | Met-Thr-Lys-Pro-Gln-Val | Met-Thr-Lys-Pro-Gln-Val | 964 |
| Met-Thr-Lys-Pro-Gln-Arg-Val | Met-Thr-Lys-Pro-Gln-Arg-Val | Met-Thr-Lys-Pro-Gln-Arg-Val | 965 |
| Met-Thr-Lys-Pro-Gln-Phe-Val | Met-Thr-Lys-Pro-Gln-Phe-Val | Met-Thr-Lys-Pro-Gln-Phe-Val | 966 |
| Met-Thr-Lys-Pro-Gln-Tyr-Val | Met-Thr-Lys-Pro-Gln-Tyr-Val | Met-Thr-Lys-Pro-Gln-Tyr-Val | 967 |
| Met-Thr-Lys-Pro-Gln-His-Val | Met-Thr-Lys-Pro-Gln-His-Val | Met-Thr-Lys-Pro-Gln-His-Val | 968 |
| Met-Thr-Lys-Pro-Gln-Pro-Val | Met-Thr-Lys-Pro-Gln-Pro-Val | Met-Thr-Lys-Pro-Gln-Pro-Val | 969 |
| Met-Thr-Lys-Pro-Gln-Lys-Val | Met-Thr-Lys-Pro-Gln-Lys-Val | Met-Thr-Lys-Pro-Gln-Lys-Val | 970 |
| Met-Thr-Lys-Pro-Asn-Val | Met-Thr-Lys-Pro-Asn-Val | Met-Thr-Lys-Pro-Asn-Val | 971 |
| Met-Thr-Lys-Pro-Asn-Arg-Val | Met-Thr-Lys-Pro-Asn-Arg-Val | Met-Thr-Lys-Pro-Asn-Arg-Val | 972 |
| Met-Thr-Lys-Pro-Asn-Phe-Val | Met-Thr-Lys-Pro-Asn-Phe-Val | Met-Thr-Lys-Pro-Asn-Phe-Val | 973 |
| Met-Thr-Lys-Pro-Asn-Tyr-Val | Met-Thr-Lys-Pro-Asn-Tyr-Val | Met-Thr-Lys-Pro-Asn-Tyr-Val | 974 |
| Met-Thr-Lys-Pro-Asn-His-Val | Met-Thr-Lys-Pro-Asn-His-Val | Met-Thr-Lys-Pro-Asn-His-Val | 975 |
| Met-Thr-Lys-Pro-Asn-Pro-Val | Met-Thr-Lys-Pro-Asn-Pro-Val | Met-Thr-Lys-Pro-Asn-Pro-Val | 976 |
| Met-Thr-Lys-Pro-Asn-Lys-Val | Met-Thr-Lys-Pro-Asn-Lys-Val | Met-Thr-Lys-Pro-Asn-Lys-Val | 977 |

TABLE 1-continued

| X-OH | X-OCH₃ | X-NH₂ | SEQ ID NO |
|---|---|---|---|
| Met-Thr-Lys-Pro-Tyr-Val | Met-Thr-Lys-Pro-Tyr-Val | Met-Thr-Lys-Pro-Tyr-Val | 978 |
| Met-Thr-Lys-Pro-Tyr-Arg-Val | Met-Thr-Lys-Pro-Tyr-Arg-Val | Met-Thr-Lys-Pro-Tyr-Arg-Val | 979 |
| Met-Thr-Lys-Pro-Tyr-Phe-Val | Met-Thr-Lys-Pro-Tyr-Phe-Val | Met-Thr-Lys-Pro-Tyr-Phe-Val | 980 |
| Met-Thr-Lys-Pro-Tyr-Tyr-Val | Met-Thr-Lys-Pro-Tyr-Tyr-Val | Met-Thr-Lys-Pro-Tyr-Tyr-Val | 981 |
| Met-Thr-Lys-Pro-Tyr-His-Val | Met-Thr-Lys-Pro-Tyr-His-Val | Met-Thr-Lys-Pro-Tyr-His-Val | 982 |
| Met-Thr-Lys-Pro-Tyr-Pro-Val | Met-Thr-Lys-Pro-Tyr-Pro-Val | Met-Thr-Lys-Pro-Tyr-Pro-Val | 983 |
| Met-Thr-Lys-Pro-Tyr-Lys-Val | Met-Thr-Lys-Pro-Tyr-Lys-Val | Met-Thr-Lys-Pro-Tyr-Lys-Val | 984 |
| Met-Thr-Lys-Pro-Arg-Val | Met-Thr-Lys-Pro-Arg-Val | Met-Thr-Lys-Pro-Arg-Val | 985 |
| Met-Thr-Lys-Pro-Arg-Arg-Val | Met-Thr-Lys-Pro-Arg-Arg-Val | Met-Thr-Lys-Pro-Arg-Arg-Val | 986 |
| Met-Thr-Lys-Pro-Arg-Phe-Val | Met-Thr-Lys-Pro-Arg-Phe-Val | Met-Thr-Lys-Pro-Arg-Phe-Val | 987 |
| Met-Thr-Lys-Pro-Arg-Tyr-Val | Met-Thr-Lys-Pro-Arg-Tyr-Val | Met-Thr-Lys-Pro-Arg-Tyr-Val | 988 |
| Met-Thr-Lys-Pro-Arg-His-Val | Met-Thr-Lys-Pro-Arg-His-Val | Met-Thr-Lys-Pro-Arg-His-Val | 989 |
| Met-Thr-Lys-Pro-Arg-Pro-Val | Met-Thr-Lys-Pro-Arg-Pro-Val | Met-Thr-Lys-Pro-Arg-Pro-Val | 990 |
| Met-Thr-Lys-Pro-Arg-Lys-Val | Met-Thr-Lys-Pro-Arg-Lys-Val | Met-Thr-Lys-Pro-Arg-Lys-Val | 991 |
| Met(O)-Thr-Lys-Pro-Val | Met(O)-Thr-Lys-Pro-Val | Met(O)-Thr-Lys-Pro-Val | 992 |
| Met(O)-Thr-Lys-Pro-Arg-Val | Met(O)-Thr-Lys-Pro-Arg-Val | Met(O)-Thr-Lys-Pro-Arg-Val | 993 |
| Met(O)-Thr-Lys-Pro-Phe-Val | Met(O)-Thr-Lys-Pro-Phe-Val | Met(O)-Thr-Lys-Pro-Phe-Val | 994 |
| Met(O)-Thr-Lys-Pro-Tyr-Val | Met(O)-Thr-Lys-Pro-Tyr-Val | Met(O)-Thr-Lys-Pro-Tyr-Val | 995 |
| Met(O)-Thr-Lys-Pro-Gly-Val | Met(O)-Thr-Lys-Pro-Gly-Val | Met(O)-Thr-Lys-Pro-Gly-Val | 996 |
| Met(O)-Thr-Lys-Pro-His-Val | Met(O)-Thr-Lys-Pro-His-Val | Met(O)-Thr-Lys-Pro-His-Val | 997 |
| Met(O)-Thr-Lys-Pro-Lys-Val | Met(O)-Thr-Lys-Pro-Lys-Val | Met(O)-Thr-Lys-Pro-Lys-Val | 998 |
| Met(O)-Thr-Lys-Pro-Gly-Val | Met(O)-Thr-Lys-Pro-Gly-Val | Met(O)-Thr-Lys-Pro-Gly-Val | 999 |
| Met(O)-Thr-Lys-Pro-Gly-Arg-Val | Met(O)-Thr-Lys-Pro-Gly-Arg-Val | Met(O)-Thr-Lys-Pro-Gly-Arg-Val | 1000 |
| Met(O)-Thr-Lys-Pro-Gly-Phe-Val | Met(O)-Thr-Lys-Pro-Gly-Phe-Val | Met(O)-Thr-Lys-Pro-Gly-Phe-Val | 1001 |
| Met(O)-Thr-Lys-Pro-Gly-Tyr-Val | Met(O)-Thr-Lys-Pro-Gly-Tyr-Val | Met(O)-Thr-Lys-Pro-Gly-Tyr-Val | 1002 |
| Met(O)-Thr-Lys-Pro-Gly-His-Val | Met(O)-Thr-Lys-Pro-Gly-His-Val | Met(O)-Thr-Lys-Pro-Gly-His-Val | 1003 |
| Met(O)-Thr-Lys-Pro-Gly-Pro-Val | Met(O)-Thr-Lys-Pro-Gly-Pro-Val | Met(O)-Thr-Lys-Pro-Gly-Pro-Val | 1004 |
| Met(O)-Thr-Lys-Pro-Gly-Lys-Val | Met(O)-Thr-Lys-Pro-Gly-Lys-Val | Met(O)-Thr-Lys-Pro-Gly-Lys-Val | 1005 |
| Met(O)-Thr-Lys-Pro-Asp-Val | Met(O)-Thr-Lys-Pro-Asp-Val | Met(O)-Thr-Lys-Pro-Asp-Val | 1006 |
| Met(O)-Thr-Lys-Pro-Asp-Arg-Val | Met(O)-Thr-Lys-Pro-Asp-Arg-Val | Met(O)-Thr-Lys-Pro-Asp-Arg-Val | 1007 |
| Met(O)-Thr-Lys-Pro-Asp-Phe-Val | Met(O)-Thr-Lys-Pro-Asp-Phe-Val | Met(O)-Thr-Lys-Pro-Asp-Phe-Val | 1008 |
| Met(O)-Thr-Lys-Pro-Asp-Tyr-Val | Met(O)-Thr-Lys-Pro-Asp-Tyr-Val | Met(O)-Thr-Lys-Pro-Asp-Tyr-Val | 1009 |
| Met(O)-Thr-Lys-Pro-Asp-His-Val | Met(O)-Thr-Lys-Pro-Asp-His-Val | Met(O)-Thr-Lys-Pro-Asp-His-Val | 1010 |

TABLE 1-continued

| X-OH | X-OCH₃ | X-NH₂ | SEQ ID NO |
|---|---|---|---|
| Met(O)-Thr-Lys-Pro-Asp-Pro-Val | Met(O)-Thr-Lys-Pro-Asp-Pro-Val | Met(O)-Thr-Lys-Pro-Asp-Pro-Val | 1011 |
| Met(O)-Thr-Lys-Pro-Asp-Lys-Val | Met(O)-Thr-Lys-Pro-Asp-Lys-Val | Met(O)-Thr-Lys-Pro-Asp-Lys-Val | 1012 |
| Met(O)-Thr-Lys-Pro-Trp-Val | Met(O)-Thr-Lys-Pro-Trp-Val | Met(O)-Thr-Lys-Pro-Trp-Val | 1013 |
| Met(O)-Thr-Lys-Pro-Trp-Arg-Val | Met(O)-Thr-Lys-Pro-Trp-Arg-Val | Met(O)-Thr-Lys-Pro-Trp-Arg-Val | 1014 |
| Met(O)-Thr-Lys-Pro-Trp-Phe-Val | Met(O)-Thr-Lys-Pro-Trp-Phe-Val | Met(O)-Thr-Lys-Pro-Trp-Phe-Val | 1015 |
| Met(O)-Thr-Lys-Pro-Trp-Tyr-Val | Met(O)-Thr-Lys-Pro-Trp-Tyr-Val | Met(O)-Thr-Lys-Pro-Trp-Tyr-Val | 1016 |
| Met(O)-Thr-Lys-Pro-Trp-His-Val | Met(O)-Thr-Lys-Pro-Trp-His-Val | Met(O)-Thr-Lys-Pro-Trp-His-Val | 1017 |
| Met(O)-Thr-Lys-Pro-Trp-Pro-Val | Met(O)-Thr-Lys-Pro-Trp-Pro-Val | Met(O)-Thr-Lys-Pro-Trp-Pro-Val | 1018 |
| Met(O)-Thr-Lys-Pro-Trp-Lys-Val | Met(O)-Thr-Lys-Pro-Trp-Lys-Val | Met(O)-Thr-Lys-Pro-Trp-Lys-Val | 1019 |
| Met(O)-Thr-Lys-Pro-Gln-Val | Met(O)-Thr-Lys-Pro-Gln-Val | Met(O)-Thr-Lys-Pro-Gln-Val | 1020 |
| Met(O)-Thr-Lys-Pro-Gln-Arg-Val | Met(O)-Thr-Lys-Pro-Gln-Arg-Val | Met(O)-Thr-Lys-Pro-Gln-Arg-Val | 1021 |
| Met(O)-Thr-Lys-Pro-Gln-Phe-Val | Met(O)-Thr-Lys-Pro-Gln-Phe-Val | Met(O)-Thr-Lys-Pro-Gln-Phe-Val | 1022 |
| Met(O)-Thr-Lys-Pro-Gln-Tyr-Val | Met(O)-Thr-Lys-Pro-Gln-Tyr-Val | Met(O)-Thr-Lys-Pro-Gln-Tyr-Val | 1023 |
| Met(O)-Thr-Lys-Pro-Gln-His-Val | Met(O)-Thr-Lys-Pro-Gln-His-Val | Met(O)-Thr-Lys-Pro-Gln-His-Val | 1024 |
| Met(O)-Thr-Lys-Pro-Gln-Pro-Val | Met(O)-Thr-Lys-Pro-Gln-Pro-Val | Met(O)-Thr-Lys-Pro-Gln-Pro-Val | 1025 |
| Met(O)-Thr-Lys-Pro-Gln-Lys-Val | Met(O)-Thr-Lys-Pro-Gln-Lys-Val | Met(O)-Thr-Lys-Pro-Gln-Lys-Val | 1026 |
| Met(O)-Thr-Lys-Pro-Asn-Val | Met(O)-Thr-Lys-Pro-Asn-Val | Met(O)-Thr-Lys-Pro-Asn-Val | 1027 |
| Met(O)-Thr-Lys-Pro-Asn-Arg-Val | Met(O)-Thr-Lys-Pro-Asn-Arg-Val | Met(O)-Thr-Lys-Pro-Asn-Arg-Val | 1028 |
| Met(O)-Thr-Lys-Pro-Asn-Phe-Val | Met(O)-Thr-Lys-Pro-Asn-Phe-Val | Met(O)-Thr-Lys-Pro-Asn-Phe-Val | 1029 |
| Met(O)-Thr-Lys-Pro-Asn-Tyr-Val | Met(O)-Thr-Lys-Pro-Asn-Tyr-Val | Met(O)-Thr-Lys-Pro-Asn-Tyr-Val | 1030 |
| Met(O)-Thr-Lys-Pro-Asn-His-Val | Met(O)-Thr-Lys-Pro-Asn-His-Val | Met(O)-Thr-Lys-Pro-Asn-His-Val | 1031 |
| Met(O)-Thr-Lys-Pro-Asn-Pro-Val | Met(O)-Thr-Lys-Pro-Asn-Pro-Val | Met(O)-Thr-Lys-Pro-Asn-Pro-Val | 1032 |
| Met(O)-Thr-Lys-Pro-Asn-Lys-Val | Met(O)-Thr-Lys-Pro-Asn-Lys-Val | Met(O)-Thr-Lys-Pro-Asn-Lys-Val | 1033 |
| Met(O)-Thr-Lys-Pro-Tyr-Val | Met(O)-Thr-Lys-Pro-Tyr-Val | Met(O)-Thr-Lys-Pro-Tyr-Val | 1034 |
| Met(O)-Thr-Lys-Pro-Tyr-Arg-Val | Met(O)-Thr-Lys-Pro-Tyr-Arg-Val | Met(O)-Thr-Lys-Pro-Tyr-Arg-Val | 1035 |
| Met(O)-Thr-Lys-Pro-Tyr-Phe-Val | Met(O)-Thr-Lys-Pro-Tyr-Phe-Val | Met(O)-Thr-Lys-Pro-Tyr-Phe-Val | 1036 |

TABLE 1-continued

| X-OH | X-OCH₃ | X-NH₂ | SEQ ID NO |
|---|---|---|---|
| Met(O)-Thr-Lys-Pro-Tyr-Tyr-Val | Met(O)-Thr-Lys-Pro-Tyr-Tyr-Val | Met(O)-Thr-Lys-Pro-Tyr-Tyr-Val | 1037 |
| Met(O)-Thr-Lys-Pro-Tyr-His-Val | Met(O)-Thr-Lys-Pro-Tyr-His-Val | Met(O)-Thr-Lys-Pro-Tyr-His-Val | 1038 |
| Met(O)-Thr-Lys-Pro-Tyr-Pro-Val | Met(O)-Thr-Lys-Pro-Tyr-Pro-Val | Met(O)-Thr-Lys-Pro-Tyr-Pro-Val | 1039 |
| Met(O)-Thr-Lys-Pro-Tyr-Lys-Val | Met(O)-Thr-Lys-Pro-Tyr-Lys-Val | Met(O)-Thr-Lys-Pro-Tyr-Lys-Val | 1040 |
| Met(O)-Thr-Lys-Pro-Arg-Val | Met(O)-Thr-Lys-Pro-Arg-Val | Met(O)-Thr-Lys-Pro-Arg-Val | 1041 |
| Met(O)-Thr-Lys-Pro-Arg-Arg-Val | Met(O)-Thr-Lys-Pro-Arg-Arg-Val | Met(O)-Thr-Lys-Pro-Arg-Arg-Val | 1042 |
| Met(O)-Thr-Lys-Pro-Arg-Phe-Val | Met(O)-Thr-Lys-Pro-Arg-Phe-Val | Met(O)-Thr-Lys-Pro-Arg-Phe-Val | 1043 |
| Met(O)-Thr-Lys-Pro-Arg-Tyr-Val | Met(O)-Thr-Lys-Pro-Arg-Tyr-Val | Met(O)-Thr-Lys-Pro-Arg-Tyr-Val | 1044 |
| Met(O)-Thr-Lys-Pro-Arg-His-Val | Met(O)-Thr-Lys-Pro-Arg-His-Val | Met(O)-Thr-Lys-Pro-Arg-His-Val | 1045 |
| Met(O)-Thr-Lys-Pro-Arg-Pro-Val | Met(O)-Thr-Lys-Pro-Arg-Pro-Val | Met(O)-Thr-Lys-Pro-Arg-Pro-Val | 1046 |
| Met(O)-Thr-Lys-Pro-Arg-Lys-Val | Met(O)-Thr-Lys-Pro-Arg-Lys-Val | Met(O)-Thr-Lys-Pro-Arg-Lys-Val | 1047 |
| Thr-Thr-Lys-Pro-Val | Thr-Thr-Lys-Pro-Val | Thr-Thr-Lys-Pro-Val | 1048 |
| Thr-Thr-Lys-Pro-Arg-Val | Thr-Thr-Lys-Pro-Arg-Val | Thr-Thr-Lys-Pro-Arg-Val | 1049 |
| Thr-Thr-Lys-Pro-Phe-Val | Thr-Thr-Lys-Pro-Phe-Val | Thr-Thr-Lys-Pro-Phe-Val | 1050 |
| Thr-Thr-Lys-Pro-Tyr-Val | Thr-Thr-Lys-Pro-Tyr-Val | Thr-Thr-Lys-Pro-Tyr-Val | 1051 |
| Thr-Thr-Lys-Pro-Gly-Val | Thr-Thr-Lys-Pro-Gly-Val | Thr-Thr-Lys-Pro-Gly-Val | 1052 |
| Thr-Thr-Lys-Pro-His-Val | Thr-Thr-Lys-Pro-His-Val | Thr-Thr-Lys-Pro-His-Val | 1053 |
| Thr-Thr-Lys-Pro-Lys-Val | Thr-Thr-Lys-Pro-Lys-Val | Thr-Thr-Lys-Pro-Lys-Val | 1054 |
| Thr-Thr-Lys-Pro-Gly-Val | Thr-Thr-Lys-Pro-Gly-Val | Thr-Thr-Lys-Pro-Gly-Val | 1055 |
| Thr-Thr-Lys-Pro-Gly-Arg-Val | Thr-Thr-Lys-Pro-Gly-Arg-Val | Thr-Thr-Lys-Pro-Gly-Arg-Val | 1056 |
| Thr-Thr-Lys-Pro-Gly-Phe-Val | Thr-Thr-Lys-Pro-Gly-Phe-Val | Thr-Thr-Lys-Pro-Gly-Phe-Val | 1057 |
| Thr-Thr-Lys-Pro-Gly-Tyr-Val | Thr-Thr-Lys-Pro-Gly-Tyr-Val | Thr-Thr-Lys-Pro-Gly-Tyr-Val | 1058 |
| Thr-Thr-Lys-Pro-Gly-His-Val | Thr-Thr-Lys-Pro-Gly-His-Val | Thr-Thr-Lys-Pro-Gly-His-Val | 1059 |
| Thr-Thr-Lys-Pro-Gly-Pro-Val | Thr-Thr-Lys-Pro-Gly-Pro-Val | Thr-Thr-Lys-Pro-Gly-Pro-Val | 1060 |
| Thr-Thr-Lys-Pro-Gly-Lys-Val | Thr-Thr-Lys-Pro-Gly-Lys-Val | Thr-Thr-Lys-Pro-Gly-Lys-Val | 1061 |
| Thr-Thr-Lys-Pro-Asp-Val | Thr-Thr-Lys-Pro-Asp-Val | Thr-Thr-Lys-Pro-Asp-Val | 1062 |
| Thr-Thr-Lys-Pro-Asp-Arg-Val | Thr-Thr-Lys-Pro-Asp-Arg-Val | Thr-Thr-Lys-Pro-Asp-Arg-Val | 1063 |
| Thr-Thr-Lys-Pro-Asp-Phe-Val | Thr-Thr-Lys-Pro-Asp-Phe-Val | Thr-Thr-Lys-Pro-Asp-Phe-Val | 1064 |
| Thr-Thr-Lys-Pro-Asp-Tyr-Val | Thr-Thr-Lys-Pro-Asp-Tyr-Val | Thr-Thr-Lys-Pro-Asp-Tyr-Val | 1065 |
| Thr-Thr-Lys-Pro-Asp-His-Val | Thr-Thr-Lys-Pro-Asp-His-Val | Thr-Thr-Lys-Pro-Asp-His-Val | 1066 |
| Thr-Thr-Lys-Pro-Asp-Pro-Val | Thr-Thr-Lys-Pro-Asp-Pro-Val | Thr-Thr-Lys-Pro-Asp-Pro-Val | 1067 |
| Thr-Thr-Lys-Pro-Asp-Lys-Val | Thr-Thr-Lys-Pro-Asp-Lys-Val | Thr-Thr-Lys-Pro-Asp-Lys-Val | 1068 |
| Thr-Thr-Lys-Pro-Trp-Val | Thr-Thr-Lys-Pro-Trp-Val | Thr-Thr-Lys-Pro-Trp-Val | 1069 |

TABLE 1-continued

| X-OH | X-OCH₃ | X-NH₂ | SEQ ID NO |
|---|---|---|---|
| Thr-Thr-Lys-Pro-Trp-Arg-Val | Thr-Thr-Lys-Pro-Trp-Arg-Val | Thr-Thr-Lys-Pro-Trp-Arg-Val | 1070 |
| Thr-Thr-Lys-Pro-Trp-Phe-Val | Thr-Thr-Lys-Pro-Trp-Phe-Val | Thr-Thr-Lys-Pro-Trp-Phe-Val | 1071 |
| Thr-Thr-Lys-Pro-Trp-Tyr-Val | Thr-Thr-Lys-Pro-Trp-Tyr-Val | Thr-Thr-Lys-Pro-Trp-Tyr-Val | 1072 |
| Thr-Thr-Lys-Pro-Trp-His-Val | Thr-Thr-Lys-Pro-Trp-His-Val | Thr-Thr-Lys-Pro-Trp-His-Val | 1073 |
| Thr-Thr-Lys-Pro-Trp-Pro-Val | Thr-Thr-Lys-Pro-Trp-Pro-Val | Thr-Thr-Lys-Pro-Trp-Pro-Val | 1074 |
| Thr-Thr-Lys-Pro-Trp-Lys-Val | Thr-Thr-Lys-Pro-Trp-Lys-Val | Thr-Thr-Lys-Pro-Trp-Lys-Val | 1075 |
| Thr-Thr-Lys-Pro-Gln-Val | Thr-Thr-Lys-Pro-Gln-Val | Thr-Thr-Lys-Pro-Gln-Val | 1076 |
| Thr-Thr-Lys-Pro-Gln-Arg-Val | Thr-Thr-Lys-Pro-Gln-Arg-Val | Thr-Thr-Lys-Pro-Gln-Arg-Val | 1077 |
| Thr-Thr-Lys-Pro-Gln-Phe-Val | Thr-Thr-Lys-Pro-Gln-Phe-Val | Thr-Thr-Lys-Pro-Gln-Phe-Val | 1078 |
| Thr-Thr-Lys-Pro-Gln-Tyr-Val | Thr-Thr-Lys-Pro-Gln-Tyr-Val | Thr-Thr-Lys-Pro-Gln-Tyr-Val | 1079 |
| Thr-Thr-Lys-Pro-Gln-His-Val | Thr-Thr-Lys-Pro-Gln-His-Val | Thr-Thr-Lys-Pro-Gln-His-Val | 1080 |
| Thr-Thr-Lys-Pro-Gln-Pro-Val | Thr-Thr-Lys-Pro-Gln-Pro-Val | Thr-Thr-Lys-Pro-Gln-Pro-Val | 1081 |
| Thr-Thr-Lys-Pro-Gln-Lys-Val | Thr-Thr-Lys-Pro-Gln-Lys-Val | Thr-Thr-Lys-Pro-Gln-Lys-Val | 1082 |
| Thr-Thr-Lys-Pro-Asn-Val | Thr-Thr-Lys-Pro-Asn-Val | Thr-Thr-Lys-Pro-Asn-Val | 1083 |
| Thr-Thr-Lys-Pro-Asn-Arg-Val | Thr-Thr-Lys-Pro-Asn-Arg-Val | Thr-Thr-Lys-Pro-Asn-Arg-Val | 1084 |
| Thr-Thr-Lys-Pro-Asn-Phe-Val | Thr-Thr-Lys-Pro-Asn-Phe-Val | Thr-Thr-Lys-Pro-Asn-Phe-Val | 1085 |
| Thr-Thr-Lys-Pro-Asn-Tyr-Val | Thr-Thr-Lys-Pro-Asn-Tyr-Val | Thr-Thr-Lys-Pro-Asn-Tyr-Val | 1086 |
| Thr-Thr-Lys-Pro-Asn-His-Val | Thr-Thr-Lys-Pro-Asn-His-Val | Thr-Thr-Lys-Pro-Asn-His-Val | 1087 |
| Thr-Thr-Lys-Pro-Asn-Pro-Val | Thr-Thr-Lys-Pro-Asn-Pro-Val | Thr-Thr-Lys-Pro-Asn-Pro-Val | 1088 |
| Thr-Thr-Lys-Pro-Asn-Lys-Val | Thr-Thr-Lys-Pro-Asn-Lys-Val | Thr-Thr-Lys-Pro-Asn-Lys-Val | 1089 |
| Thr-Thr-Lys-Pro-Tyr-Val | Thr-Thr-Lys-Pro-Tyr-Val | Thr-Thr-Lys-Pro-Tyr-Val | 1090 |
| Thr-Thr-Lys-Pro-Tyr-Arg-Val | Thr-Thr-Lys-Pro-Tyr-Arg-Val | Thr-Thr-Lys-Pro-Tyr-Arg-Val | 1091 |
| Thr-Thr-Lys-Pro-Tyr-Phe-Val | Thr-Thr-Lys-Pro-Tyr-Phe-Val | Thr-Thr-Lys-Pro-Tyr-Phe-Val | 1092 |
| Thr-Thr-Lys-Pro-Tyr-Tyr-Val | Thr-Thr-Lys-Pro-Tyr-Tyr-Val | Thr-Thr-Lys-Pro-Tyr-Tyr-Val | 1093 |
| Thr-Thr-Lys-Pro-Tyr-His-Val | Thr-Thr-Lys-Pro-Tyr-His-Val | Thr-Thr-Lys-Pro-Tyr-His-Val | 1094 |
| Thr-Thr-Lys-Pro-Tyr-Pro-Val | Thr-Thr-Lys-Pro-Tyr-Pro-Val | Thr-Thr-Lys-Pro-Tyr-Pro-Val | 1095 |
| Thr-Thr-Lys-Pro-Tyr-Lys-Val | Thr-Thr-Lys-Pro-Tyr-Lys-Val | Thr-Thr-Lys-Pro-Tyr-Lys-Val | 1096 |
| Thr-Thr-Lys-Pro-Arg-Val | Thr-Thr-Lys-Pro-Arg-Val | Thr-Thr-Lys-Pro-Arg-Val | 1097 |
| Thr-Thr-Lys-Pro-Arg-Arg-Val | Thr-Thr-Lys-Pro-Arg-Arg-Val | Thr-Thr-Lys-Pro-Arg-Arg-Val | 1098 |
| Thr-Thr-Lys-Pro-Arg-Phe-Val | Thr-Thr-Lys-Pro-Arg-Phe-Val | Thr-Thr-Lys-Pro-Arg-Phe-Val | 1099 |
| Thr-Thr-Lys-Pro-Arg-Tyr-Val | Thr-Thr-Lys-Pro-Arg-Tyr-Val | Thr-Thr-Lys-Pro-Arg-Tyr-Val | 1100 |
| Thr-Thr-Lys-Pro-Arg-His-Val | Thr-Thr-Lys-Pro-Arg-His-Val | Thr-Thr-Lys-Pro-Arg-His-Val | 1101 |
| Thr-Thr-Lys-Pro-Arg-Pro-Val | Thr-Thr-Lys-Pro-Arg-Pro-Val | Thr-Thr-Lys-Pro-Arg-Pro-Val | 1102 |
| Thr-Thr-Lys-Pro-Arg-Lys-Val | Thr-Thr-Lys-Pro-Arg-Lys-Val | Thr-Thr-Lys-Pro-Arg-Lys-Val | 1103 |
| Ala-Thr-Lys-Pro-Val | Ala-Thr-Lys-Pro-Val | Ala-Thr-Lys-Pro-Val | 1104 |
| Ala-Thr-Lys-Pro-Arg-Val | Ala-Thr-Lys-Pro-Arg-Val | Ala-Thr-Lys-Pro-Arg-Val | 1105 |
| Ala-Thr-Lys-Pro-Phe-Val | Ala-Thr-Lys-Pro-Phe-Val | Ala-Thr-Lys-Pro-Phe-Val | 1106 |
| Ala-Thr-Lys-Pro-Tyr-Val | Ala-Thr-Lys-Pro-Tyr-Val | Ala-Thr-Lys-Pro-Tyr-Val | 1107 |

TABLE 1-continued

| X-OH | X-OCH₃ | X-NH₂ | SEQ ID NO |
|---|---|---|---|
| Ala-Thr-Lys-Pro-Gly-Val | Ala-Thr-Lys-Pro-Gly-Val | Ala-Thr-Lys-Pro-Gly-Val | 1108 |
| Ala-Thr-Lys-Pro-His-Val | Ala-Thr-Lys-Pro-His-Val | Ala-Thr-Lys-Pro-His-Val | 1109 |
| Ala-Thr-Lys-Pro-Lys-Val | Ala-Thr-Lys-Pro-Lys-Val | Ala-Thr-Lys-Pro-Lys-Val | 1110 |
| Ala-Thr-Lys-Pro-Gly-Val | Ala-Thr-Lys-Pro-Gly-Val | Ala-Thr-Lys-Pro-Gly-Val | 1111 |
| Ala-Thr-Lys-Pro-Gly-Arg-Val | Ala-Thr-Lys-Pro-Gly-Arg-Val | Ala-Thr-Lys-Pro-Gly-Arg-Val | 1112 |
| Ala-Thr-Lys-Pro-Gly-Phe-Val | Ala-Thr-Lys-Pro-Gly-Phe-Val | Ala-Thr-Lys-Pro-Gly-Phe-Val | 1113 |
| Ala-Thr-Lys-Pro-Gly-Tyr-Val | Ala-Thr-Lys-Pro-Gly-Tyr-Val | Ala-Thr-Lys-Pro-Gly-Tyr-Val | 1114 |
| Ala-Thr-Lys-Pro-Gly-His-Val | Ala-Thr-Lys-Pro-Gly-His-Val | Ala-Thr-Lys-Pro-Gly-His-Val | 1115 |
| Ala-Thr-Lys-Pro-Gly-Pro-Val | Ala-Thr-Lys-Pro-Gly-Pro-Val | Ala-Thr-Lys-Pro-Gly-Pro-Val | 1116 |
| Ala-Thr-Lys-Pro-Gly-Lys-Val | Ala-Thr-Lys-Pro-Gly-Lys-Val | Ala-Thr-Lys-Pro-Gly-Lys-Val | 1117 |
| Ala-Thr-Lys-Pro-Asp-Val | Ala-Thr-Lys-Pro-Asp-Val | Ala-Thr-Lys-Pro-Asp-Val | 1118 |
| Ala-Thr-Lys-Pro-Asp-Arg-Val | Ala-Thr-Lys-Pro-Asp-Arg-Val | Ala-Thr-Lys-Pro-Asp-Arg-Val | 1119 |
| Ala-Thr-Lys-Pro-Asp-Phe-Val | Ala-Thr-Lys-Pro-Asp-Phe-Val | Ala-Thr-Lys-Pro-Asp-Phe-Val | 1120 |
| Ala-Thr-Lys-Pro-Asp-Tyr-Val | Ala-Thr-Lys-Pro-Asp-Tyr-Val | Ala-Thr-Lys-Pro-Asp-Tyr-Val | 1121 |
| Ala-Thr-Lys-Pro-Asp-His-Val | Ala-Thr-Lys-Pro-Asp-His-Val | Ala-Thr-Lys-Pro-Asp-His-Val | 1122 |
| Ala-Thr-Lys-Pro-Asp-Pro-Val | Ala-Thr-Lys-Pro-Asp-Pro-Val | Ala-Thr-Lys-Pro-Asp-Pro-Val | 1123 |
| Ala-Thr-Lys-Pro-Asp-Lys-Val | Ala-Thr-Lys-Pro-Asp-Lys-Val | Ala-Thr-Lys-Pro-Asp-Lys-Val | 1124 |
| Ala-Thr-Lys-Pro-Trp-Val | Ala-Thr-Lys-Pro-Trp-Val | Ala-Thr-Lys-Pro-Trp-Val | 1125 |
| Ala-Thr-Lys-Pro-Trp-Arg-Val | Ala-Thr-Lys-Pro-Trp-Arg-Val | Ala-Thr-Lys-Pro-Trp-Arg-Val | 1126 |
| Ala-Thr-Lys-Pro-Trp-Phe-Val | Ala-Thr-Lys-Pro-Trp-Phe-Val | Ala-Thr-Lys-Pro-Trp-Phe-Val | 1127 |
| Ala-Thr-Lys-Pro-Trp-Tyr-Val | Ala-Thr-Lys-Pro-Trp-Tyr-Val | Ala-Thr-Lys-Pro-Trp-Tyr-Val | 1128 |
| Ala-Thr-Lys-Pro-Trp-His-Val | Ala-Thr-Lys-Pro-Trp-His-Val | Ala-Thr-Lys-Pro-Trp-His-Val | 1129 |
| Ala-Thr-Lys-Pro-Trp-Pro-Val | Ala-Thr-Lys-Pro-Trp-Pro-Val | Ala-Thr-Lys-Pro-Trp-Pro-Val | 1130 |
| Ala-Thr-Lys-Pro-Trp-Lys-Val | Ala-Thr-Lys-Pro-Trp-Lys-Val | Ala-Thr-Lys-Pro-Trp-Lys-Val | 1131 |
| Ala-Thr-Lys-Pro-Gln-Val | Ala-Thr-Lys-Pro-Gln-Val | Ala-Thr-Lys-Pro-Gln-Val | 1132 |
| Ala-Thr-Lys-Pro-Gln-Arg-Val | Ala-Thr-Lys-Pro-Gln-Arg-Val | Ala-Thr-Lys-Pro-Gln-Arg-Val | 1133 |
| Ala-Thr-Lys-Pro-Gln-Phe-Val | Ala-Thr-Lys-Pro-Gln-Phe-Val | Ala-Thr-Lys-Pro-Gln-Phe-Val | 1134 |
| Ala-Thr-Lys-Pro-Gln-Tyr-Val | Ala-Thr-Lys-Pro-Gln-Tyr-Val | Ala-Thr-Lys-Pro-Gln-Tyr-Val | 1135 |
| Ala-Thr-Lys-Pro-Gln-His-Val | Ala-Thr-Lys-Pro-Gln-His-Val | Ala-Thr-Lys-Pro-Gln-His-Val | 1136 |
| Ala-Thr-Lys-Pro-Gln-Pro-Val | Ala-Thr-Lys-Pro-Gln-Pro-Val | Ala-Thr-Lys-Pro-Gln-Pro-Val | 1137 |
| Ala-Thr-Lys-Pro-Gln-Lys-Val | Ala-Thr-Lys-Pro-Gln-Lys-Val | Ala-Thr-Lys-Pro-Gln-Lys-Val | 1138 |
| Ala-Thr-Lys-Pro-Asn-Val | Ala-Thr-Lys-Pro-Asn-Val | Ala-Thr-Lys-Pro-Asn-Val | 1139 |
| Ala-Thr-Lys-Pro-Asn-Arg-Val | Ala-Thr-Lys-Pro-Asn-Arg-Val | Ala-Thr-Lys-Pro-Asn-Arg-Val | 1140 |
| Ala-Thr-Lys-Pro-Asn-Phe-Val | Ala-Thr-Lys-Pro-Asn-Phe-Val | Ala-Thr-Lys-Pro-Asn-Phe-Val | 1141 |
| Ala-Thr-Lys-Pro-Asn-Tyr-Val | Ala-Thr-Lys-Pro-Asn-Tyr-Val | Ala-Thr-Lys-Pro-Asn-Tyr-Val | 1142 |
| Ala-Thr-Lys-Pro-Asn-His-Val | Ala-Thr-Lys-Pro-Asn-His-Val | Ala-Thr-Lys-Pro-Asn-His-Val | 1143 |
| Ala-Thr-Lys-Pro-Asn-Pro-Val | Ala-Thr-Lys-Pro-Asn-Pro-Val | Ala-Thr-Lys-Pro-Asn-Pro-Val | 1144 |
| Ala-Thr-Lys-Pro-Asn-Lys-Val | Ala-Thr-Lys-Pro-Asn-Lys-Val | Ala-Thr-Lys-Pro-Asn-Lys-Val | 1145 |

TABLE 1-continued

| X-OH | X-OCH₃ | X-NH₂ | SEQ ID NO |
|---|---|---|---|
| Ala-Thr-Lys-Pro-Tyr-Val | Ala-Thr-Lys-Pro-Tyr-Val | Ala-Thr-Lys-Pro-Tyr-Val | 1146 |
| Ala-Thr-Lys-Pro-Tyr-Arg-Val | Ala-Thr-Lys-Pro-Tyr-Arg-Val | Ala-Thr-Lys-Pro-Tyr-Arg-Val | 1147 |
| Ala-Thr-Lys-Pro-Tyr-Phe-Val | Ala-Thr-Lys-Pro-Tyr-Phe-Val | Ala-Thr-Lys-Pro-Tyr-Phe-Val | 1148 |
| Ala-Thr-Lys-Pro-Tyr-Tyr-Val | Ala-Thr-Lys-Pro-Tyr-Tyr-Val | Ala-Thr-Lys-Pro-Tyr-Tyr-Val | 1149 |
| Ala-Thr-Lys-Pro-Tyr-His-Val | Ala-Thr-Lys-Pro-Tyr-His-Val | Ala-Thr-Lys-Pro-Tyr-His-Val | 1150 |
| Ala-Thr-Lys-Pro-Tyr-Pro-Val | Ala-Thr-Lys-Pro-Tyr-Pro-Val | Ala-Thr-Lys-Pro-Tyr-Pro-Val | 1151 |
| Ala-Thr-Lys-Pro-Tyr-Lys-Val | Ala-Thr-Lys-Pro-Tyr-Lys-Val | Ala-Thr-Lys-Pro-Tyr-Lys-Val | 1152 |
| Ala-Thr-Lys-Pro-Arg-Val | Ala-Thr-Lys-Pro-Arg-Val | Ala-Thr-Lys-Pro-Arg-Val | 1153 |
| Ala-Thr-Lys-Pro-Arg-Arg-Val | Ala-Thr-Lys-Pro-Arg-Arg-Val | Ala-Thr-Lys-Pro-Arg-Arg-Val | 1154 |
| Ala-Thr-Lys-Pro-Arg-Phe-Val | Ala-Thr-Lys-Pro-Arg-Phe-Val | Ala-Thr-Lys-Pro-Arg-Phe-Val | 1155 |
| Ala-Thr-Lys-Pro-Arg-Tyr-Val | Ala-Thr-Lys-Pro-Arg-Tyr-Val | Ala-Thr-Lys-Pro-Arg-Tyr-Val | 1156 |
| Ala-Thr-Lys-Pro-Arg-His-Val | Ala-Thr-Lys-Pro-Arg-His-Val | Ala-Thr-Lys-Pro-Arg-His-Val | 1157 |
| Ala-Thr-Lys-Pro-Arg-Pro-Val | Ala-Thr-Lys-Pro-Arg-Pro-Val | Ala-Thr-Lys-Pro-Arg-Pro-Val | 1158 |
| Ala-Thr-Lys-Pro-Arg-Lys-Val | Ala-Thr-Lys-Pro-Arg-Lys-Val | Ala-Thr-Lys-Pro-Arg-Lys-Val | 1159 |
| His-Thr-Lys-Pro-Val | His-Thr-Lys-Pro-Val | His-Thr-Lys-Pro-Val | 1160 |
| His-Thr-Lys-Pro-Arg-Val | His-Thr-Lys-Pro-Arg-Val | His-Thr-Lys-Pro-Arg-Val | 1161 |
| His-Thr-Lys-Pro-Phe-Val | His-Thr-Lys-Pro-Phe-Val | His-Thr-Lys-Pro-Phe-Val | 1162 |
| His-Thr-Lys-Pro-Tyr-Val | His-Thr-Lys-Pro-Tyr-Val | His-Thr-Lys-Pro-Tyr-Val | 1163 |
| His-Thr-Lys-Pro-Gly-Val | His-Thr-Lys-Pro-Gly-Val | His-Thr-Lys-Pro-Gly-Val | 1164 |
| His-Thr-Lys-Pro-His-Val | His-Thr-Lys-Pro-His-Val | His-Thr-Lys-Pro-His-Val | 1165 |
| His-Thr-Lys-Pro-Lys-Val | His-Thr-Lys-Pro-Lys-Val | His-Thr-Lys-Pro-Lys-Val | 1166 |
| His-Thr-Lys-Pro-Gly-Val | His-Thr-Lys-Pro-Gly-Val | His-Thr-Lys-Pro-Gly-Val | 1167 |
| His-Thr-Lys-Pro-Gly-Arg-Val | His-Thr-Lys-Pro-Gly-Arg-Val | His-Thr-Lys-Pro-Gly-Arg-Val | 1168 |
| His-Thr-Lys-Pro-Gly-Phe-Val | His-Thr-Lys-Pro-Gly-Phe-Val | His-Thr-Lys-Pro-Gly-Phe-Val | 1169 |
| His-Thr-Lys-Pro-Gly-Tyr-Val | His-Thr-Lys-Pro-Gly-Tyr-Val | His-Thr-Lys-Pro-Gly-Tyr-Val | 1170 |
| His-Thr-Lys-Pro-Gly-His-Val | His-Thr-Lys-Pro-Gly-His-Val | His-Thr-Lys-Pro-Gly-His-Val | 1171 |
| His-Thr-Lys-Pro-Gly-Pro-Val | His-Thr-Lys-Pro-Gly-Pro-Val | His-Thr-Lys-Pro-Gly-Pro-Val | 1172 |
| His-Thr-Lys-Pro-Gly-Lys-Val | His-Thr-Lys-Pro-Gly-Lys-Val | His-Thr-Lys-Pro-Gly-Lys-Val | 1173 |
| His-Thr-Lys-Pro-Asp-Val | His-Thr-Lys-Pro-Asp-Val | His-Thr-Lys-Pro-Asp-Val | 1174 |
| His-Thr-Lys-Pro-Asp-Arg-Val | His-Thr-Lys-Pro-Asp-Arg-Val | His-Thr-Lys-Pro-Asp-Arg-Val | 1175 |
| His-Thr-Lys-Pro-Asp-Phe-Val | His-Thr-Lys-Pro-Asp-Phe-Val | His-Thr-Lys-Pro-Asp-Phe-Val | 1176 |
| His-Thr-Lys-Pro-Asp-Tyr-Val | His-Thr-Lys-Pro-Asp-Tyr-Val | His-Thr-Lys-Pro-Asp-Tyr-Val | 1177 |
| His-Thr-Lys-Pro-Asp-His-Val | His-Thr-Lys-Pro-Asp-His-Val | His-Thr-Lys-Pro-Asp-His-Val | 1178 |
| His-Thr-Lys-Pro-Asp-Pro-Val | His-Thr-Lys-Pro-Asp-Pro-Val | His-Thr-Lys-Pro-Asp-Pro-Val | 1179 |
| His-Thr-Lys-Pro-Asp-Lys-Val | His-Thr-Lys-Pro-Asp-Lys-Val | His-Thr-Lys-Pro-Asp-Lys-Val | 1180 |
| His-Thr-Lys-Pro-Trp-Val | His-Thr-Lys-Pro-Trp-Val | His-Thr-Lys-Pro-Trp-Val | 1181 |
| His-Thr-Lys-Pro-Trp-Arg-Val | His-Thr-Lys-Pro-Trp-Arg-Val | His-Thr-Lys-Pro-Trp-Arg-Val | 1182 |
| His-Thr-Lys-Pro-Trp-Phe-Val | His-Thr-Lys-Pro-Trp-Phe-Val | His-Thr-Lys-Pro-Trp-Phe-Val | 1183 |

TABLE 1-continued

| X-OH | X-OCH₃ | X-NH₂ | SEQ ID NO |
|---|---|---|---|
| His-Thr-Lys-Pro-Trp-Tyr-Val | His-Thr-Lys-Pro-Trp-Tyr-Val | His-Thr-Lys-Pro-Trp-Tyr-Val | 1184 |
| His-Thr-Lys-Pro-Trp-His-Val | His-Thr-Lys-Pro-Trp-His-Val | His-Thr-Lys-Pro-Trp-His-Val | 1185 |
| His-Thr-Lys-Pro-Trp-Pro-Val | His-Thr-Lys-Pro-Trp-Pro-Val | His-Thr-Lys-Pro-Trp-Pro-Val | 1186 |
| His-Thr-Lys-Pro-Trp-Lys-Val | His-Thr-Lys-Pro-Trp-Lys-Val | His-Thr-Lys-Pro-Trp-Lys-Val | 1187 |
| His-Thr-Lys-Pro-Gln-Val | His-Thr-Lys-Pro-Gln-Val | His-Thr-Lys-Pro-Gln-Val | 1188 |
| His-Thr-Lys-Pro-Gln-Arg-Val | His-Thr-Lys-Pro-Gln-Arg-Val | His-Thr-Lys-Pro-Gln-Arg-Val | 1189 |
| His-Thr-Lys-Pro-Gln-Phe-Val | His-Thr-Lys-Pro-Gln-Phe-Val | His-Thr-Lys-Pro-Gln-Phe-Val | 1190 |
| His-Thr-Lys-Pro-Gln-Tyr-Val | His-Thr-Lys-Pro-Gln-Tyr-Val | His-Thr-Lys-Pro-Gln-Tyr-Val | 1191 |
| His-Thr-Lys-Pro-Gln-His-Val | His-Thr-Lys-Pro-Gln-His-Val | His-Thr-Lys-Pro-Gln-His-Val | 1192 |
| His-Thr-Lys-Pro-Gln-Pro-Val | His-Thr-Lys-Pro-Gln-Pro-Val | His-Thr-Lys-Pro-Gln-Pro-Val | 1193 |
| His-Thr-Lys-Pro-Gln-Lys-Val | His-Thr-Lys-Pro-Gln-Lys-Val | His-Thr-Lys-Pro-Gln-Lys-Val | 1194 |
| His-Thr-Lys-Pro-Asn-Val | His-Thr-Lys-Pro-Asn-Val | His-Thr-Lys-Pro-Asn-Val | 1195 |
| His-Thr-Lys-Pro-Asn-Arg-Val | His-Thr-Lys-Pro-Asn-Arg-Val | His-Thr-Lys-Pro-Asn-Arg-Val | 1196 |
| His-Thr-Lys-Pro-Asn-Phe-Val | His-Thr-Lys-Pro-Asn-Phe-Val | His-Thr-Lys-Pro-Asn-Phe-Val | 1197 |
| His-Thr-Lys-Pro-Asn-Tyr-Val | His-Thr-Lys-Pro-Asn-Tyr-Val | His-Thr-Lys-Pro-Asn-Tyr-Val | 1198 |
| His-Thr-Lys-Pro-Asn-His-Val | His-Thr-Lys-Pro-Asn-His-Val | His-Thr-Lys-Pro-Asn-His-Val | 1199 |
| His-Thr-Lys-Pro-Asn-Pro-Val | His-Thr-Lys-Pro-Asn-Pro-Val | His-Thr-Lys-Pro-Asn-Pro-Val | 1200 |
| His-Thr-Lys-Pro-Asn-Lys-Val | His-Thr-Lys-Pro-Asn-Lys-Val | His-Thr-Lys-Pro-Asn-Lys-Val | 1201 |
| His-Thr-Lys-Pro-Tyr-Val | His-Thr-Lys-Pro-Tyr-Val | His-Thr-Lys-Pro-Tyr-Val | 1202 |
| His-Thr-Lys-Pro-Tyr-Arg-Val | His-Thr-Lys-Pro-Tyr-Arg-Val | His-Thr-Lys-Pro-Tyr-Arg-Val | 1203 |
| His-Thr-Lys-Pro-Tyr-Phe-Val | His-Thr-Lys-Pro-Tyr-Phe-Val | His-Thr-Lys-Pro-Tyr-Phe-Val | 1204 |
| His-Thr-Lys-Pro-Tyr-Tyr-Val | His-Thr-Lys-Pro-Tyr-Tyr-Val | His-Thr-Lys-Pro-Tyr-Tyr-Val | 1205 |
| His-Thr-Lys-Pro-Tyr-His-Val | His-Thr-Lys-Pro-Tyr-His-Val | His-Thr-Lys-Pro-Tyr-His-Val | 1206 |
| His-Thr-Lys-Pro-Tyr-Pro-Val | His-Thr-Lys-Pro-Tyr-Pro-Val | His-Thr-Lys-Pro-Tyr-Pro-Val | 1207 |
| His-Thr-Lys-Pro-Tyr-Lys-Val | His-Thr-Lys-Pro-Tyr-Lys-Val | His-Thr-Lys-Pro-Tyr-Lys-Val | 1208 |
| His-Thr-Lys-Pro-Arg-Val | His-Thr-Lys-Pro-Arg-Val | His-Thr-Lys-Pro-Arg-Val | 1209 |
| His-Thr-Lys-Pro-Arg-Arg-Val | His-Thr-Lys-Pro-Arg-Arg-Val | His-Thr-Lys-Pro-Arg-Arg-Val | 1210 |
| His-Thr-Lys-Pro-Arg-Phe-Val | His-Thr-Lys-Pro-Arg-Phe-Val | His-Thr-Lys-Pro-Arg-Phe-Val | 1211 |
| His-Thr-Lys-Pro-Arg-Tyr-Val | His-Thr-Lys-Pro-Arg-Tyr-Val | His-Thr-Lys-Pro-Arg-Tyr-Val | 1212 |
| His-Thr-Lys-Pro-Arg-His-Val | His-Thr-Lys-Pro-Arg-His-Val | His-Thr-Lys-Pro-Arg-His-Val | 1213 |
| His-Thr-Lys-Pro-Arg-Pro-Val | His-Thr-Lys-Pro-Arg-Pro-Val | His-Thr-Lys-Pro-Arg-Pro-Val | 1214 |
| His-Thr-Lys-Pro-Arg-Lys-Val | His-Thr-Lys-Pro-Arg-Lys-Val | His-Thr-Lys-Pro-Arg-Lys-Val | 1215 |
| Lys-Thr-Lys-Pro-Val | Lys-Thr-Lys-Pro-Val | Lys-Thr-Lys-Pro-Val | 1216 |
| Lys-Thr-Lys-Pro-Arg-Val | Lys-Thr-Lys-Pro-Arg-Val | Lys-Thr-Lys-Pro-Arg-Val | 1217 |
| Lys-Thr-Lys-Pro-Phe-Val | Lys-Thr-Lys-Pro-Phe-Val | Lys-Thr-Lys-Pro-Phe-Val | 1218 |
| Lys-Thr-Lys-Pro-Tyr-Val | Lys-Thr-Lys-Pro-Tyr-Val | Lys-Thr-Lys-Pro-Tyr-Val | 1219 |
| Lys-Thr-Lys-Pro-Gly-Val | Lys-Thr-Lys-Pro-Gly-Val | Lys-Thr-Lys-Pro-Gly-Val | 1220 |
| Lys-Thr-Lys-Pro-His-Val | Lys-Thr-Lys-Pro-His-Val | Lys-Thr-Lys-Pro-His-Val | 1221 |

TABLE 1-continued

| X-OH | X-OCH₃ | X-NH₂ | SEQ ID NO |
|---|---|---|---|
| Lys-Thr-Lys-Pro-Lys-Val | Lys-Thr-Lys-Pro-Lys-Val | Lys-Thr-Lys-Pro-Lys-Val | 1222 |
| Lys-Thr-Lys-Pro-Gly-Val | Lys-Thr-Lys-Pro-Gly-Val | Lys-Thr-Lys-Pro-Gly-Val | 1223 |
| Lys-Thr-Lys-Pro-Gly-Arg-Val | Lys-Thr-Lys-Pro-Gly-Arg-Val | Lys-Thr-Lys-Pro-Gly-Arg-Val | 1224 |
| Lys-Thr-Lys-Pro-Gly-Phe-Val | Lys-Thr-Lys-Pro-Gly-Phe-Val | Lys-Thr-Lys-Pro-Gly-Phe-Val | 1225 |
| Lys-Thr-Lys-Pro-Gly-Tyr-Val | Lys-Thr-Lys-Pro-Gly-Tyr-Val | Lys-Thr-Lys-Pro-Gly-Tyr-Val | 1226 |
| Lys-Thr-Lys-Pro-Gly-His-Val | Lys-Thr-Lys-Pro-Gly-His-Val | Lys-Thr-Lys-Pro-Gly-His-Val | 1227 |
| Lys-Thr-Lys-Pro-Gly-Pro-Val | Lys-Thr-Lys-Pro-Gly-Pro-Val | Lys-Thr-Lys-Pro-Gly-Pro-Val | 1228 |
| Lys-Thr-Lys-Pro-Gly-Lys-Val | Lys-Thr-Lys-Pro-Gly-Lys-Val | Lys-Thr-Lys-Pro-Gly-Lys-Val | 1229 |
| Lys-Thr-Lys-Pro-Asp-Val | Lys-Thr-Lys-Pro-Asp-Val | Lys-Thr-Lys-Pro-Asp-Val | 1230 |
| Lys-Thr-Lys-Pro-Asp-Arg-Val | Lys-Thr-Lys-Pro-Asp-Arg-Val | Lys-Thr-Lys-Pro-Asp-Arg-Val | 1231 |
| Lys-Thr-Lys-Pro-Asp-Phe-Val | Lys-Thr-Lys-Pro-Asp-Phe-Val | Lys-Thr-Lys-Pro-Asp-Phe-Val | 1232 |
| Lys-Thr-Lys-Pro-Asp-Tyr-Val | Lys-Thr-Lys-Pro-Asp-Tyr-Val | Lys-Thr-Lys-Pro-Asp-Tyr-Val | 1233 |
| Lys-Thr-Lys-Pro-Asp-His-Val | Lys-Thr-Lys-Pro-Asp-His-Val | Lys-Thr-Lys-Pro-Asp-His-Val | 1234 |
| Lys-Thr-Lys-Pro-Asp-Pro-Val | Lys-Thr-Lys-Pro-Asp-Pro-Val | Lys-Thr-Lys-Pro-Asp-Pro-Val | 1235 |
| Lys-Thr-Lys-Pro-Asp-Lys-Val | Lys-Thr-Lys-Pro-Asp-Lys-Val | Lys-Thr-Lys-Pro-Asp-Lys-Val | 1236 |
| Lys-Thr-Lys-Pro-Trp-Val | Lys-Thr-Lys-Pro-Trp-Val | Lys-Thr-Lys-Pro-Trp-Val | 1237 |
| Lys-Thr-Lys-Pro-Trp-Arg-Val | Lys-Thr-Lys-Pro-Trp-Arg-Val | Lys-Thr-Lys-Pro-Trp-Arg-Val | 1238 |
| Lys-Thr-Lys-Pro-Trp-Phe-Val | Lys-Thr-Lys-Pro-Trp-Phe-Val | Lys-Thr-Lys-Pro-Trp-Phe-Val | 1239 |
| Lys-Thr-Lys-Pro-Trp-Tyr-Val | Lys-Thr-Lys-Pro-Trp-Tyr-Val | Lys-Thr-Lys-Pro-Trp-Tyr-Val | 1240 |
| Lys-Thr-Lys-Pro-Trp-His-Val | Lys-Thr-Lys-Pro-Trp-His-Val | Lys-Thr-Lys-Pro-Trp-His-Val | 1241 |
| Lys-Thr-Lys-Pro-Trp-Pro-Val | Lys-Thr-Lys-Pro-Trp-Pro-Val | Lys-Thr-Lys-Pro-Trp-Pro-Val | 1242 |
| Lys-Thr-Lys-Pro-Trp-Lys-Val | Lys-Thr-Lys-Pro-Trp-Lys-Val | Lys-Thr-Lys-Pro-Trp-Lys-Val | 1243 |
| Lys-Thr-Lys-Pro-Gln-Val | Lys-Thr-Lys-Pro-Gln-Val | Lys-Thr-Lys-Pro-Gln-Val | 1244 |
| Lys-Thr-Lys-Pro-Gln-Arg-Val | Lys-Thr-Lys-Pro-Gln-Arg-Val | Lys-Thr-Lys-Pro-Gln-Arg-Val | 1245 |
| Lys-Thr-Lys-Pro-Gln-Phe-Val | Lys-Thr-Lys-Pro-Gln-Phe-Val | Lys-Thr-Lys-Pro-Gln-Phe-Val | 1246 |
| Lys-Thr-Lys-Pro-Gln-Tyr-Val | Lys-Thr-Lys-Pro-Gln-Tyr-Val | Lys-Thr-Lys-Pro-Gln-Tyr-Val | 1247 |
| Lys-Thr-Lys-Pro-Gln-His-Val | Lys-Thr-Lys-Pro-Gln-His-Val | Lys-Thr-Lys-Pro-Gln-His-Val | 1248 |
| Lys-Thr-Lys-Pro-Gln-Pro-Val | Lys-Thr-Lys-Pro-Gln-Pro-Val | Lys-Thr-Lys-Pro-Gln-Pro-Val | 1249 |
| Lys-Thr-Lys-Pro-Gln-Lys-Val | Lys-Thr-Lys-Pro-Gln-Lys-Val | Lys-Thr-Lys-Pro-Gln-Lys-Val | 1250 |
| Lys-Thr-Lys-Pro-Asn-Val | Lys-Thr-Lys-Pro-Asn-Val | Lys-Thr-Lys-Pro-Asn-Val | 1251 |
| Lys-Thr-Lys-Pro-Asn-Arg-Val | Lys-Thr-Lys-Pro-Asn-Arg-Val | Lys-Thr-Lys-Pro-Asn-Arg-Val | 1252 |
| Lys-Thr-Lys-Pro-Asn-Phe-Val | Lys-Thr-Lys-Pro-Asn-Phe-Val | Lys-Thr-Lys-Pro-Asn-Phe-Val | 1253 |
| Lys-Thr-Lys-Pro-Asn-Tyr-Val | Lys-Thr-Lys-Pro-Asn-Tyr-Val | Lys-Thr-Lys-Pro-Asn-Tyr-Val | 1254 |
| Lys-Thr-Lys-Pro-Asn-His-Val | Lys-Thr-Lys-Pro-Asn-His-Val | Lys-Thr-Lys-Pro-Asn-His-Val | 1255 |
| Lys-Thr-Lys-Pro-Asn-Pro-Val | Lys-Thr-Lys-Pro-Asn-Pro-Val | Lys-Thr-Lys-Pro-Asn-Pro-Val | 1256 |
| Lys-Thr-Lys-Pro-Asn-Lys-Val | Lys-Thr-Lys-Pro-Asn-Lys-Val | Lys-Thr-Lys-Pro-Asn-Lys-Val | 1257 |
| Lys-Thr-Lys-Pro-Tyr-Val | Lys-Thr-Lys-Pro-Tyr-Val | Lys-Thr-Lys-Pro-Tyr-Val | 1258 |
| Lys-Thr-Lys-Pro-Tyr-Arg-Val | Lys-Thr-Lys-Pro-Tyr-Arg-Val | Lys-Thr-Lys-Pro-Tyr-Arg-Val | 1259 |

TABLE 1-continued

| X-OH | X-OCH₃ | X-NH₂ | SEQ ID NO |
|---|---|---|---|
| Lys-Thr-Lys-Pro-Tyr-Phe-Val | Lys-Thr-Lys-Pro-Tyr-Phe-Val | Lys-Thr-Lys-Pro-Tyr-Phe-Val | 1260 |
| Lys-Thr-Lys-Pro-Tyr-Tyr-Val | Lys-Thr-Lys-Pro-Tyr-Tyr-Val | Lys-Thr-Lys-Pro-Tyr-Tyr-Val | 1261 |
| Lys-Thr-Lys-Pro-Tyr-His-Val | Lys-Thr-Lys-Pro-Tyr-His-Val | Lys-Thr-Lys-Pro-Tyr-His-Val | 1262 |
| Lys-Thr-Lys-Pro-Tyr-Pro-Val | Lys-Thr-Lys-Pro-Tyr-Pro-Val | Lys-Thr-Lys-Pro-Tyr-Pro-Val | 1263 |
| Lys-Thr-Lys-Pro-Tyr-Lys-Val | Lys-Thr-Lys-Pro-Tyr-Lys-Val | Lys-Thr-Lys-Pro-Tyr-Lys-Val | 1264 |
| Lys-Thr-Lys-Pro-Arg-Val | Lys-Thr-Lys-Pro-Arg-Val | Lys-Thr-Lys-Pro-Arg-Val | 1265 |
| Lys-Thr-Lys-Pro-Arg-Arg-Val | Lys-Thr-Lys-Pro-Arg-Arg-Val | Lys-Thr-Lys-Pro-Arg-Arg-Val | 1266 |
| Lys-Thr-Lys-Pro-Arg-Phe-Val | Lys-Thr-Lys-Pro-Arg-Phe-Val | Lys-Thr-Lys-Pro-Arg-Phe-Val | 1267 |
| Lys-Thr-Lys-Pro-Arg-Tyr-Val | Lys-Thr-Lys-Pro-Arg-Tyr-Val | Lys-Thr-Lys-Pro-Arg-Tyr-Val | 1268 |
| Lys-Thr-Lys-Pro-Arg-His-Val | Lys-Thr-Lys-Pro-Arg-His-Val | Lys-Thr-Lys-Pro-Arg-His-Val | 1269 |
| Lys-Thr-Lys-Pro-Arg-Pro-Val | Lys-Thr-Lys-Pro-Arg-Pro-Val | Lys-Thr-Lys-Pro-Arg-Pro-Val | 1270 |
| Lys-Thr-Lys-Pro-Arg-Lys-Val | Lys-Thr-Lys-Pro-Arg-Lys-Val | Lys-Thr-Lys-Pro-Arg-Lys-Val | 1271 |
| Gly-Thr-Lys-Pro-Val | Gly-Thr-Lys-Pro-Val | Gly-Thr-Lys-Pro-Val | 1272 |
| Gly-Thr-Lys-Pro-Arg-Val | Gly-Thr-Lys-Pro-Arg-Val | Gly-Thr-Lys-Pro-Arg-Val | 1273 |
| Gly-Thr-Lys-Pro-Phe-Val | Gly-Thr-Lys-Pro-Phe-Val | Gly-Thr-Lys-Pro-Phe-Val | 1274 |
| Gly-Thr-Lys-Pro-Tyr-Val | Gly-Thr-Lys-Pro-Tyr-Val | Gly-Thr-Lys-Pro-Tyr-Val | 1275 |
| Gly-Thr-Lys-Pro-Gly-Val | Gly-Thr-Lys-Pro-Gly-Val | Gly-Thr-Lys-Pro-Gly-Val | 1276 |
| Gly-Thr-Lys-Pro-His-Val | Gly-Thr-Lys-Pro-His-Val | Gly-Thr-Lys-Pro-His-Val | 1277 |
| Gly-Thr-Lys-Pro-Lys-Val | Gly-Thr-Lys-Pro-Lys-Val | Gly-Thr-Lys-Pro-Lys-Val | 1278 |
| Gly-Thr-Lys-Pro-Gly-Val | Gly-Thr-Lys-Pro-Gly-Val | Gly-Thr-Lys-Pro-Gly-Val | 1279 |
| Gly-Thr-Lys-Pro-Gly-Arg-Val | Gly-Thr-Lys-Pro-Gly-Arg-Val | Gly-Thr-Lys-Pro-Gly-Arg-Val | 1280 |
| Gly-Thr-Lys-Pro-Gly-Phe-Val | Gly-Thr-Lys-Pro-Gly-Phe-Val | Gly-Thr-Lys-Pro-Gly-Phe-Val | 1281 |
| Gly-Thr-Lys-Pro-Gly-Tyr-Val | Gly-Thr-Lys-Pro-Gly-Tyr-Val | Gly-Thr-Lys-Pro-Gly-Tyr-Val | 1282 |
| Gly-Thr-Lys-Pro-Gly-His-Val | Gly-Thr-Lys-Pro-Gly-His-Val | Gly-Thr-Lys-Pro-Gly-His-Val | 1283 |
| Gly-Thr-Lys-Pro-Gly-Pro-Val | Gly-Thr-Lys-Pro-Gly-Pro-Val | Gly-Thr-Lys-Pro-Gly-Pro-Val | 1284 |
| Gly-Thr-Lys-Pro-Gly-Lys-Val | Gly-Thr-Lys-Pro-Gly-Lys-Val | Gly-Thr-Lys-Pro-Gly-Lys-Val | 1285 |
| Gly-Thr-Lys-Pro-Asp-Val | Gly-Thr-Lys-Pro-Asp-Val | Gly-Thr-Lys-Pro-Asp-Val | 1286 |
| Gly-Thr-Lys-Pro-Asp-Arg-Val | Gly-Thr-Lys-Pro-Asp-Arg-Val | Gly-Thr-Lys-Pro-Asp-Arg-Val | 1287 |
| Gly-Thr-Lys-Pro-Asp-Phe-Val | Gly-Thr-Lys-Pro-Asp-Phe-Val | Gly-Thr-Lys-Pro-Asp-Phe-Val | 1288 |
| Gly-Thr-Lys-Pro-Asp-Tyr-Val | Gly-Thr-Lys-Pro-Asp-Tyr-Val | Gly-Thr-Lys-Pro-Asp-Tyr-Val | 1289 |
| Gly-Thr-Lys-Pro-Asp-His-Val | Gly-Thr-Lys-Pro-Asp-His-Val | Gly-Thr-Lys-Pro-Asp-His-Val | 1290 |
| Gly-Thr-Lys-Pro-Asp-Pro-Val | Gly-Thr-Lys-Pro-Asp-Pro-Val | Gly-Thr-Lys-Pro-Asp-Pro-Val | 1291 |
| Gly-Thr-Lys-Pro-Asp-Lys-Val | Gly-Thr-Lys-Pro-Asp-Lys-Val | Gly-Thr-Lys-Pro-Asp-Lys-Val | 1292 |
| Gly-Thr-Lys-Pro-Trp-Val | Gly-Thr-Lys-Pro-Trp-Val | Gly-Thr-Lys-Pro-Trp-Val | 1293 |
| Gly-Thr-Lys-Pro-Trp-Arg-Val | Gly-Thr-Lys-Pro-Trp-Arg-Val | Gly-Thr-Lys-Pro-Trp-Arg-Val | 1294 |
| Gly-Thr-Lys-Pro-Trp-Phe-Val | Gly-Thr-Lys-Pro-Trp-Phe-Val | Gly-Thr-Lys-Pro-Trp-Phe-Val | 1295 |
| Gly-Thr-Lys-Pro-Trp-Tyr-Val | Gly-Thr-Lys-Pro-Trp-Tyr-Val | Gly-Thr-Lys-Pro-Trp-Tyr-Val | 1296 |
| Gly-Thr-Lys-Pro-Trp-His-Val | Gly-Thr-Lys-Pro-Trp-His-Val | Gly-Thr-Lys-Pro-Trp-His-Val | 1297 |

TABLE 1-continued

| X—OH | X—OCH₃ | X—NH₂ | SEQ ID NO |
|---|---|---|---|
| Gly-Thr-Lys-Pro-Trp-Pro-Val | Gly-Thr-Lys-Pro-Trp-Pro-Val | Gly-Thr-Lys-Pro-Trp-Pro-Val | 1298 |
| Gly-Thr-Lys-Pro-Trp-Lys-Val | Gly-Thr-Lys-Pro-Trp-Lys-Val | Gly-Thr-Lys-Pro-Trp-Lys-Val | 1299 |
| Gly-Thr-Lys-Pro-Gln-Val | Gly-Thr-Lys-Pro-Gln-Val | Gly-Thr-Lys-Pro-Gln-Val | 1300 |
| Gly-Thr-Lys-Pro-Gln-Arg-Val | Gly-Thr-Lys-Pro-Gln-Arg-Val | Gly-Thr-Lys-Pro-Gln-Arg-Val | 1301 |
| Gly-Thr-Lys-Pro-Gln-Phe-Val | Gly-Thr-Lys-Pro-Gln-Phe-Val | Gly-Thr-Lys-Pro-Gln-Phe-Val | 1302 |
| Gly-Thr-Lys-Pro-Gln-Tyr-Val | Gly-Thr-Lys-Pro-Gln-Tyr-Val | Gly-Thr-Lys-Pro-Gln-Tyr-Val | 1303 |
| Gly-Thr-Lys-Pro-Gln-His-Val | Gly-Thr-Lys-Pro-Gln-His-Val | Gly-Thr-Lys-Pro-Gln-His-Val | 1304 |
| Gly-Thr-Lys-Pro-Gln-Pro-Val | Gly-Thr-Lys-Pro-Gln-Pro-Val | Gly-Thr-Lys-Pro-Gln-Pro-Val | 1305 |
| Gly-Thr-Lys-Pro-Gln-Lys-Val | Gly-Thr-Lys-Pro-Gln-Lys-Val | Gly-Thr-Lys-Pro-Gln-Lys-Val | 1306 |
| Gly-Thr-Lys-Pro-Asn-Val | Gly-Thr-Lys-Pro-Asn-Val | Gly-Thr-Lys-Pro-Asn-Val | 1307 |
| Gly-Thr-Lys-Pro-Asn-Arg-Val | Gly-Thr-Lys-Pro-Asn-Arg-Val | Gly-Thr-Lys-Pro-Asn-Arg-Val | 1308 |
| Gly-Thr-Lys-Pro-Asn-Phe-Val | Gly-Thr-Lys-Pro-Asn-Phe-Val | Gly-Thr-Lys-Pro-Asn-Phe-Val | 1309 |
| Gly-Thr-Lys-Pro-Asn-Tyr-Val | Gly-Thr-Lys-Pro-Asn-Tyr-Val | Gly-Thr-Lys-Pro-Asn-Tyr-Val | 1310 |
| Gly-Thr-Lys-Pro-Asn-His-Val | Gly-Thr-Lys-Pro-Asn-His-Val | Gly-Thr-Lys-Pro-Asn-His-Val | 1311 |
| Gly-Thr-Lys-Pro-Asn-Pro-Val | Gly-Thr-Lys-Pro-Asn-Pro-Val | Gly-Thr-Lys-Pro-Asn-Pro-Val | 1312 |
| Gly-Thr-Lys-Pro-Asn-Lys-Val | Gly-Thr-Lys-Pro-Asn-Lys-Val | Gly-Thr-Lys-Pro-Asn-Lys-Val | 1313 |
| Gly-Thr-Lys-Pro-Tyr-Val | Gly-Thr-Lys-Pro-Tyr-Val | Gly-Thr-Lys-Pro-Tyr-Val | 1314 |
| Gly-Thr-Lys-Pro-Tyr-Arg-Val | Gly-Thr-Lys-Pro-Tyr-Arg-Val | Gly-Thr-Lys-Pro-Tyr-Arg-Val | 1315 |
| Gly-Thr-Lys-Pro-Tyr-Phe-Val | Gly-Thr-Lys-Pro-Tyr-Phe-Val | Gly-Thr-Lys-Pro-Tyr-Phe-Val | 1316 |
| Gly-Thr-Lys-Pro-Tyr-Tyr-Val | Gly-Thr-Lys-Pro-Tyr-Tyr-Val | Gly-Thr-Lys-Pro-Tyr-Tyr-Val | 1317 |
| Gly-Thr-Lys-Pro-Tyr-His-Val | Gly-Thr-Lys-Pro-Tyr-His-Val | Gly-Thr-Lys-Pro-Tyr-His-Val | 1318 |
| Gly-Thr-Lys-Pro-Tyr-Pro-Val | Gly-Thr-Lys-Pro-Tyr-Pro-Val | Gly-Thr-Lys-Pro-Tyr-Pro-Val | 1319 |
| Gly-Thr-Lys-Pro-Tyr-Lys-Val | Gly-Thr-Lys-Pro-Tyr-Lys-Val | Gly-Thr-Lys-Pro-Tyr-Lys-Val | 1320 |
| Gly-Thr-Lys-Pro-Arg-Val | Gly-Thr-Lys-Pro-Arg-Val | Gly-Thr-Lys-Pro-Arg-Val | 1321 |
| Gly-Thr-Lys-Pro-Arg-Arg-Val | Gly-Thr-Lys-Pro-Arg-Arg-Val | Gly-Thr-Lys-Pro-Arg-Arg-Val | 1322 |
| Gly-Thr-Lys-Pro-Arg-Phe-Val | Gly-Thr-Lys-Pro-Arg-Phe-Val | Gly-Thr-Lys-Pro-Arg-Phe-Val | 1323 |
| Gly-Thr-Lys-Pro-Arg-Tyr-Val | Gly-Thr-Lys-Pro-Arg-Tyr-Val | Gly-Thr-Lys-Pro-Arg-Tyr-Val | 1324 |
| Gly-Thr-Lys-Pro-Arg-His-Val | Gly-Thr-Lys-Pro-Arg-His-Val | Gly-Thr-Lys-Pro-Arg-His-Val | 1325 |
| Gly-Thr-Lys-Pro-Arg-Pro-Val | Gly-Thr-Lys-Pro-Arg-Pro-Val | Gly-Thr-Lys-Pro-Arg-Pro-Val | 1326 |
| Gly-Thr-Lys-Pro-Arg-Lys-Val | Gly-Thr-Lys-Pro-Arg-Lys-Val | Gly-Thr-Lys-Pro-Arg-Lys-Val | 1327 |
| Met-Thr-Lys-Pro-Gly | Met-Thr-Lys-Pro-Gly | Met-Thr-Lys-Pro-Gly | 1328 |
| Met(O)-Thr-Lys-Pro-Gly | Met(O)-Thr-Lys-Pro-Gly | Met(O)-Thr-Lys-Pro-Gly | 1329 |
| Thr-Thr-Lys-Pro-Gly | Thr-Thr-Lys-Pro-Gly | Thr-Thr-Lys-Pro-Gly | 1330 |
| Ala-Thr-Lys-Pro-Gly | Ala-Thr-Lys-Pro-Gly | Ala-Thr-Lys-Pro-Gly | 1331 |
| His-Thr-Lys-Pro-Gly | His-Thr-Lys-Pro-Gly | His-Thr-Lys-Pro-Gly | 1332 |
| Lys-Thr-Lys-Pro-Gly | Lys-Thr-Lys-Pro-Gly | Lys-Thr-Lys-Pro-Gly | 1333 |
| Gly-Thr-Lys-Pro-Gly | Gly-Thr-Lys-Pro-Gly | Gly-Thr-Lys-Pro-Gly | 1334 |
| Thr-Lys-Pro-Arg-Tyr | Thr-Lys-Pro-Arg-Tyr | Thr-Lys-Pro-Arg-Tyr | 1335 |

TABLE 1-continued

| X-OH | X-OCH₃ | X-NH₂ | SEQ ID NO |
|---|---|---|---|
| Thr-Lys-Pro-Phe-Tyr | Thr-Lys-Pro-Phe-Tyr | Thr-Lys-Pro-Phe-Tyr | 1336 |
| Thr-Lys-Pro-Tyr-Tyr | Thr-Lys-Pro-Tyr-Tyr | Thr-Lys-Pro-Tyr-Tyr | 1337 |
| Thr-Lys-Pro-Gly-Tyr | Thr-Lys-Pro-Gly-Tyr | Thr-Lys-Pro-Gly-Tyr | 1338 |
| Thr-Lys-Pro-His-Tyr | Thr-Lys-Pro-His-Tyr | Thr-Lys-Pro-His-Tyr | 1339 |
| Thr-Lys-Pro-Lys-Tyr | Thr-Lys-Pro-Lys-Tyr | Thr-Lys-Pro-Lys-Tyr | 1340 |
| Thr-Lys-Pro-Gly-Tyr | Thr-Lys-Pro-Gly-Tyr | Thr-Lys-Pro-Gly-Tyr | 1341 |
| Thr-Lys-Pro-Gly-Arg-Tyr | Thr-Lys-Pro-Gly-Arg-Tyr | Thr-Lys-Pro-Gly-Arg-Tyr | 1342 |
| Thr-Lys-Pro-Gly-Phe-Tyr | Thr-Lys-Pro-Gly-Phe-Tyr | Thr-Lys-Pro-Gly-Phe-Tyr | 1343 |
| Thr-Lys-Pro-Gly-Tyr-Tyr | Thr-Lys-Pro-Gly-Tyr-Tyr | Thr-Lys-Pro-Gly-Tyr-Tyr | 1344 |
| Thr-Lys-Pro-Gly-His-Tyr | Thr-Lys-Pro-Gly-His-Tyr | Thr-Lys-Pro-Gly-His-Tyr | 1345 |
| Thr-Lys-Pro-Gly-Pro-Tyr | Thr-Lys-Pro-Gly-Pro-Tyr | Thr-Lys-Pro-Gly-Pro-Tyr | 1346 |
| Thr-Lys-Pro-Gly-Lys-Tyr | Thr-Lys-Pro-Gly-Lys-Tyr | Thr-Lys-Pro-Gly-Lys-Tyr | 1347 |
| Thr-Lys-Pro-Asp-Tyr | Thr-Lys-Pro-Asp-Tyr | Thr-Lys-Pro-Asp-Tyr | 1348 |
| Thr-Lys-Pro-Asp-Arg-Tyr | Thr-Lys-Pro-Asp-Arg-Tyr | Thr-Lys-Pro-Asp-Arg-Tyr | 1349 |
| Thr-Lys-Pro-Asp-Phe-Tyr | Thr-Lys-Pro-Asp-Phe-Tyr | Thr-Lys-Pro-Asp-Phe-Tyr | 1350 |
| Thr-Lys-Pro-Asp-Tyr-Tyr | Thr-Lys-Pro-Asp-Tyr-Tyr | Thr-Lys-Pro-Asp-Tyr-Tyr | 1351 |
| Thr-Lys-Pro-Asp-His-Tyr | Thr-Lys-Pro-Asp-His-Tyr | Thr-Lys-Pro-Asp-His-Tyr | 1352 |
| Thr-Lys-Pro-Asp-Pro-Tyr | Thr-Lys-Pro-Asp-Pro-Tyr | Thr-Lys-Pro-Asp-Pro-Tyr | 1353 |
| Thr-Lys-Pro-Asp-Lys-Tyr | Thr-Lys-Pro-Asp-Lys-Tyr | Thr-Lys-Pro-Asp-Lys-Tyr | 1354 |
| Thr-Lys-Pro-Trp-Tyr | Thr-Lys-Pro-Trp-Tyr | Thr-Lys-Pro-Trp-Tyr | 1355 |
| Thr-Lys-Pro-Trp-Arg-Tyr | Thr-Lys-Pro-Trp-Arg-Tyr | Thr-Lys-Pro-Trp-Arg-Tyr | 1356 |
| Thr-Lys-Pro-Trp-Phe-Tyr | Thr-Lys-Pro-Trp-Phe-Tyr | Thr-Lys-Pro-Trp-Phe-Tyr | 1357 |
| Thr-Lys-Pro-Trp-Tyr-Tyr | Thr-Lys-Pro-Trp-Tyr-Tyr | Thr-Lys-Pro-Trp-Tyr-Tyr | 1358 |
| Thr-Lys-Pro-Trp-His-Tyr | Thr-Lys-Pro-Trp-His-Tyr | Thr-Lys-Pro-Trp-His-Tyr | 1359 |
| Thr-Lys-Pro-Trp-Pro-Tyr | Thr-Lys-Pro-Trp-Pro-Tyr | Thr-Lys-Pro-Trp-Pro-Tyr | 1360 |
| Thr-Lys-Pro-Trp-Lys-Tyr | Thr-Lys-Pro-Trp-Lys-Tyr | Thr-Lys-Pro-Trp-Lys-Tyr | 1361 |
| Thr-Lys-Pro-Gln-Tyr | Thr-Lys-Pro-Gln-Tyr | Thr-Lys-Pro-Gln-Tyr | 1362 |
| Thr-Lys-Pro-Gln-Arg-Tyr | Thr-Lys-Pro-Gln-Arg-Tyr | Thr-Lys-Pro-Gln-Arg-Tyr | 1363 |
| Thr-Lys-Pro-Gln-Phe-Tyr | Thr-Lys-Pro-Gln-Phe-Tyr | Thr-Lys-Pro-Gln-Phe-Tyr | 1364 |
| Thr-Lys-Pro-Gln-Tyr-Tyr | Thr-Lys-Pro-Gln-Tyr-Tyr | Thr-Lys-Pro-Gln-Tyr-Tyr | 1365 |
| Thr-Lys-Pro-Gln-His-Tyr | Thr-Lys-Pro-Gln-His-Tyr | Thr-Lys-Pro-Gln-His-Tyr | 1366 |
| Thr-Lys-Pro-Gln-Pro-Tyr | Thr-Lys-Pro-Gln-Pro-Tyr | Thr-Lys-Pro-Gln-Pro-Tyr | 1367 |
| Thr-Lys-Pro-Gln-Lys-Tyr | Thr-Lys-Pro-Gln-Lys-Tyr | Thr-Lys-Pro-Gln-Lys-Tyr | 1368 |
| Thr-Lys-Pro-Asn-Tyr | Thr-Lys-Pro-Asn-Tyr | Thr-Lys-Pro-Asn-Tyr | 1369 |
| Thr-Lys-Pro-Asn-Arg-Tyr | Thr-Lys-Pro-Asn-Arg-Tyr | Thr-Lys-Pro-Asn-Arg-Tyr | 1370 |
| Thr-Lys-Pro-Asn-Phe-Tyr | Thr-Lys-Pro-Asn-Phe-Tyr | Thr-Lys-Pro-Asn-Phe-Tyr | 1371 |
| Thr-Lys-Pro-Asn-Tyr-Tyr | Thr-Lys-Pro-Asn-Tyr-Tyr | Thr-Lys-Pro-Asn-Tyr-Tyr | 1372 |
| Thr-Lys-Pro-Asn-His-Tyr | Thr-Lys-Pro-Asn-His-Tyr | Thr-Lys-Pro-Asn-His-Tyr | 1373 |

TABLE 1-continued

| X-OH | X-OCH₃ | X-NH₂ | SEQ ID NO |
|---|---|---|---|
| Thr-Lys-Pro-Asn-Pro-Tyr | Thr-Lys-Pro-Asn-Pro-Tyr | Thr-Lys-Pro-Asn-Pro-Tyr | 1374 |
| Thr-Lys-Pro-Asn-Lys-Tyr | Thr-Lys-Pro-Asn-Lys-Tyr | Thr-Lys-Pro-Asn-Lys-Tyr | 1375 |
| Thr-Lys-Pro-Tyr-Tyr | Thr-Lys-Pro-Tyr-Tyr | Thr-Lys-Pro-Tyr-Tyr | 1376 |
| Thr-Lys-Pro-Tyr-Arg-Tyr | Thr-Lys-Pro-Tyr-Arg-Tyr | Thr-Lys-Pro-Tyr-Arg-Tyr | 1377 |
| Thr-Lys-Pro-Tyr-Phe-Tyr | Thr-Lys-Pro-Tyr-Phe-Tyr | Thr-Lys-Pro-Tyr-Phe-Tyr | 1378 |
| Thr-Lys-Pro-Tyr-Tyr-Tyr | Thr-Lys-Pro-Tyr-Tyr-Tyr | Thr-Lys-Pro-Tyr-Tyr-Tyr | 1379 |
| Thr-Lys-Pro-Tyr-His-Tyr | Thr-Lys-Pro-Tyr-His-Tyr | Thr-Lys-Pro-Tyr-His-Tyr | 1380 |
| Thr-Lys-Pro-Tyr-Pro-Tyr | Thr-Lys-Pro-Tyr-Pro-Tyr | Thr-Lys-Pro-Tyr-Pro-Tyr | 1381 |
| Thr-Lys-Pro-Tyr-Lys-Tyr | Thr-Lys-Pro-Tyr-Lys-Tyr | Thr-Lys-Pro-Tyr-Lys-Tyr | 1382 |
| Thr-Lys-Pro-Arg-Tyr | Thr-Lys-Pro-Arg-Tyr | Thr-Lys-Pro-Arg-Tyr | 1383 |
| Thr-Lys-Pro-Arg-Arg-Tyr | Thr-Lys-Pro-Arg-Arg-Tyr | Thr-Lys-Pro-Arg-Arg-Tyr | 1384 |
| Thr-Lys-Pro-Arg-Phe-Tyr | Thr-Lys-Pro-Arg-Phe-Tyr | Thr-Lys-Pro-Arg-Phe-Tyr | 1385 |
| Thr-Lys-Pro-Arg-Tyr-Tyr | Thr-Lys-Pro-Arg-Tyr-Tyr | Thr-Lys-Pro-Arg-Tyr-Tyr | 1386 |
| Thr-Lys-Pro-Arg-His-Tyr | Thr-Lys-Pro-Arg-His-Tyr | Thr-Lys-Pro-Arg-His-Tyr | 1387 |
| Thr-Lys-Pro-Arg-Pro-Tyr | Thr-Lys-Pro-Arg-Pro-Tyr | Thr-Lys-Pro-Arg-Pro-Tyr | 1388 |
| Thr-Lys-Pro-Arg-Lys-Tyr | Thr-Lys-Pro-Arg-Lys-Tyr | Thr-Lys-Pro-Arg-Lys-Tyr | 1389 |
| Met-Thr-Lys-Pro-Tyr | Met-Thr-Lys-Pro-Tyr | Met-Thr-Lys-Pro-Tyr | 1390 |
| Met-Thr-Lys-Pro-Arg-Tyr | Met-Thr-Lys-Pro-Arg-Tyr | Met-Thr-Lys-Pro-Arg-Tyr | 1391 |
| Met-Thr-Lys-Pro-Phe-Tyr | Met-Thr-Lys-Pro-Phe-Tyr | Met-Thr-Lys-Pro-Phe-Tyr | 1392 |
| Met-Thr-Lys-Pro-Tyr-Tyr | Met-Thr-Lys-Pro-Tyr-Tyr | Met-Thr-Lys-Pro-Tyr-Tyr | 1393 |
| Met-Thr-Lys-Pro-Gly-Tyr | Met-Thr-Lys-Pro-Gly-Tyr | Met-Thr-Lys-Pro-Gly-Tyr | 1394 |
| Met-Thr-Lys-Pro-His-Tyr | Met-Thr-Lys-Pro-His-Tyr | Met-Thr-Lys-Pro-His-Tyr | 1395 |
| Met-Thr-Lys-Pro-Lys-Tyr | Met-Thr-Lys-Pro-Lys-Tyr | Met-Thr-Lys-Pro-Lys-Tyr | 1396 |
| Met-Thr-Lys-Pro-Gly-Tyr | Met-Thr-Lys-Pro-Gly-Tyr | Met-Thr-Lys-Pro-Gly-Tyr | 1397 |
| Met-Thr-Lys-Pro-Gly-Arg-Tyr | Met-Thr-Lys-Pro-Gly-Arg-Tyr | Met-Thr-Lys-Pro-Gly-Arg-Tyr | 1398 |
| Met-Thr-Lys-Pro-Gly-Phe-Tyr | Met-Thr-Lys-Pro-Gly-Phe-Tyr | Met-Thr-Lys-Pro-Gly-Phe-Tyr | 1399 |
| Met-Thr-Lys-Pro-Gly-Tyr-Tyr | Met-Thr-Lys-Pro-Gly-Tyr-Tyr | Met-Thr-Lys-Pro-Gly-Tyr-Tyr | 1400 |
| Met-Thr-Lys-Pro-Gly-His-Tyr | Met-Thr-Lys-Pro-Gly-His-Tyr | Met-Thr-Lys-Pro-Gly-His-Tyr | 1401 |
| Met-Thr-Lys-Pro-Gly-Pro-Tyr | Met-Thr-Lys-Pro-Gly-Pro-Tyr | Met-Thr-Lys-Pro-Gly-Pro-Tyr | 1402 |
| Met-Thr-Lys-Pro-Gly-Lys-Tyr | Met-Thr-Lys-Pro-Gly-Lys-Tyr | Met-Thr-Lys-Pro-Gly-Lys-Tyr | 1403 |
| Met-Thr-Lys-Pro-Asp-Tyr | Met-Thr-Lys-Pro-Asp-Tyr | Met-Thr-Lys-Pro-Asp-Tyr | 1404 |
| Met-Thr-Lys-Pro-Asp-Arg-Tyr | Met-Thr-Lys-Pro-Asp-Arg-Tyr | Met-Thr-Lys-Pro-Asp-Arg-Tyr | 1405 |
| Met-Thr-Lys-Pro-Asp-Phe-Tyr | Met-Thr-Lys-Pro-Asp-Phe-Tyr | Met-Thr-Lys-Pro-Asp-Phe-Tyr | 1406 |
| Met-Thr-Lys-Pro-Asp-Tyr-Tyr | Met-Thr-Lys-Pro-Asp-Tyr-Tyr | Met-Thr-Lys-Pro-Asp-Tyr-Tyr | 1407 |
| Met-Thr-Lys-Pro-Asp-His-Tyr | Met-Thr-Lys-Pro-Asp-His-Tyr | Met-Thr-Lys-Pro-Asp-His-Tyr | 1408 |
| Met-Thr-Lys-Pro-Asp-Pro-Tyr | Met-Thr-Lys-Pro-Asp-Pro-Tyr | Met-Thr-Lys-Pro-Asp-Pro-Tyr | 1409 |
| Met-Thr-Lys-Pro-Asp-Lys-Tyr | Met-Thr-Lys-Pro-Asp-Lys-Tyr | Met-Thr-Lys-Pro-Asp-Lys-Tyr | 1410 |
| Met-Thr-Lys-Pro-Trp-Tyr | Met-Thr-Lys-Pro-Trp-Tyr | Met-Thr-Lys-Pro-Trp-Tyr | 1411 |

TABLE 1-continued

| X-OH | X-OCH₃ | X-NH₂ | SEQ ID NO |
|---|---|---|---|
| Met-Thr-Lys-Pro-Trp-Arg-Tyr | Met-Thr-Lys-Pro-Trp-Arg-Tyr | Met-Thr-Lys-Pro-Trp-Arg-Tyr | 1412 |
| Met-Thr-Lys-Pro-Trp-Phe-Tyr | Met-Thr-Lys-Pro-Trp-Phe-Tyr | Met-Thr-Lys-Pro-Trp-Phe-Tyr | 1413 |
| Met-Thr-Lys-Pro-Trp-Tyr-Tyr | Met-Thr-Lys-Pro-Trp-Tyr-Tyr | Met-Thr-Lys-Pro-Trp-Tyr-Tyr | 1414 |
| Met-Thr-Lys-Pro-Trp-His-Tyr | Met-Thr-Lys-Pro-Trp-His-Tyr | Met-Thr-Lys-Pro-Trp-His-Tyr | 1415 |
| Met-Thr-Lys-Pro-Trp-Pro-Tyr | Met-Thr-Lys-Pro-Trp-Pro-Tyr | Met-Thr-Lys-Pro-Trp-Pro-Tyr | 1416 |
| Met-Thr-Lys-Pro-Trp-Lys-Tyr | Met-Thr-Lys-Pro-Trp-Lys-Tyr | Met-Thr-Lys-Pro-Trp-Lys-Tyr | 1417 |
| Met-Thr-Lys-Pro-Gln-Tyr | Met-Thr-Lys-Pro-Gln-Tyr | Met-Thr-Lys-Pro-Gln-Tyr | 1418 |
| Met-Thr-Lys-Pro-Gln-Arg-Tyr | Met-Thr-Lys-Pro-Gln-Arg-Tyr | Met-Thr-Lys-Pro-Gln-Arg-Tyr | 1419 |
| Met-Thr-Lys-Pro-Gln-Phe-Tyr | Met-Thr-Lys-Pro-Gln-Phe-Tyr | Met-Thr-Lys-Pro-Gln-Phe-Tyr | 1420 |
| Met-Thr-Lys-Pro-Gln-Tyr-Tyr | Met-Thr-Lys-Pro-Gln-Tyr-Tyr | Met-Thr-Lys-Pro-Gln-Tyr-Tyr | 1421 |
| Met-Thr-Lys-Pro-Gln-His-Tyr | Met-Thr-Lys-Pro-Gln-His-Tyr | Met-Thr-Lys-Pro-Gln-His-Tyr | 1422 |
| Met-Thr-Lys-Pro-Gln-Pro-Tyr | Met-Thr-Lys-Pro-Gln-Pro-Tyr | Met-Thr-Lys-Pro-Gln-Pro-Tyr | 1423 |
| Met-Thr-Lys-Pro-Gln-Lys-Tyr | Met-Thr-Lys-Pro-Gln-Lys-Tyr | Met-Thr-Lys-Pro-Gln-Lys-Tyr | 1424 |
| Met-Thr-Lys-Pro-Asn-Tyr | Met-Thr-Lys-Pro-Asn-Tyr | Met-Thr-Lys-Pro-Asn-Tyr | 1425 |
| Met-Thr-Lys-Pro-Asn-Arg-Tyr | Met-Thr-Lys-Pro-Asn-Arg-Tyr | Met-Thr-Lys-Pro-Asn-Arg-Tyr | 1426 |
| Met-Thr-Lys-Pro-Asn-Phe-Tyr | Met-Thr-Lys-Pro-Asn-Phe-Tyr | Met-Thr-Lys-Pro-Asn-Phe-Tyr | 1427 |
| Met-Thr-Lys-Pro-Asn-Tyr-Tyr | Met-Thr-Lys-Pro-Asn-Tyr-Tyr | Met-Thr-Lys-Pro-Asn-Tyr-Tyr | 1428 |
| Met-Thr-Lys-Pro-Asn-His-Tyr | Met-Thr-Lys-Pro-Asn-His-Tyr | Met-Thr-Lys-Pro-Asn-His-Tyr | 1429 |
| Met-Thr-Lys-Pro-Asn-Pro-Tyr | Met-Thr-Lys-Pro-Asn-Pro-Tyr | Met-Thr-Lys-Pro-Asn-Pro-Tyr | 1430 |
| Met-Thr-Lys-Pro-Asn-Lys-Tyr | Met-Thr-Lys-Pro-Asn-Lys-Tyr | Met-Thr-Lys-Pro-Asn-Lys-Tyr | 1431 |
| Met-Thr-Lys-Pro-Tyr-Tyr | Met-Thr-Lys-Pro-Tyr-Tyr | Met-Thr-Lys-Pro-Tyr-Tyr | 1432 |
| Met-Thr-Lys-Pro-Tyr-Arg-Tyr | Met-Thr-Lys-Pro-Tyr-Arg-Tyr | Met-Thr-Lys-Pro-Tyr-Arg-Tyr | 1433 |
| Met-Thr-Lys-Pro-Tyr-Phe-Tyr | Met-Thr-Lys-Pro-Tyr-Phe-Tyr | Met-Thr-Lys-Pro-Tyr-Phe-Tyr | 1434 |
| Met-Thr-Lys-Pro-Tyr-Tyr-Tyr | Met-Thr-Lys-Pro-Tyr-Tyr-Tyr | Met-Thr-Lys-Pro-Tyr-Tyr-Tyr | 1435 |
| Met-Thr-Lys-Pro-Tyr-His-Tyr | Met-Thr-Lys-Pro-Tyr-His-Tyr | Met-Thr-Lys-Pro-Tyr-His-Tyr | 1436 |
| Met-Thr-Lys-Pro-Tyr-Pro-Tyr | Met-Thr-Lys-Pro-Tyr-Pro-Tyr | Met-Thr-Lys-Pro-Tyr-Pro-Tyr | 1437 |
| Met-Thr-Lys-Pro-Tyr-Lys-Tyr | Met-Thr-Lys-Pro-Tyr-Lys-Tyr | Met-Thr-Lys-Pro-Tyr-Lys-Tyr | 1438 |
| Met-Thr-Lys-Pro-Arg-Tyr | Met-Thr-Lys-Pro-Arg-Tyr | Met-Thr-Lys-Pro-Arg-Tyr | 1439 |
| Met-Thr-Lys-Pro-Arg-Arg-Tyr | Met-Thr-Lys-Pro-Arg-Arg-Tyr | Met-Thr-Lys-Pro-Arg-Arg-Tyr | 1440 |
| Met-Thr-Lys-Pro-Arg-Phe-Tyr | Met-Thr-Lys-Pro-Arg-Phe-Tyr | Met-Thr-Lys-Pro-Arg-Phe-Tyr | 1441 |
| Met-Thr-Lys-Pro-Arg-Tyr-Tyr | Met-Thr-Lys-Pro-Arg-Tyr-Tyr | Met-Thr-Lys-Pro-Arg-Tyr-Tyr | 1442 |
| Met-Thr-Lys-Pro-Arg-His-Tyr | Met-Thr-Lys-Pro-Arg-His-Tyr | Met-Thr-Lys-Pro-Arg-His-Tyr | 1443 |
| Met-Thr-Lys-Pro-Arg-Pro-Tyr | Met-Thr-Lys-Pro-Arg-Pro-Tyr | Met-Thr-Lys-Pro-Arg-Pro-Tyr | 1444 |
| Met-Thr-Lys-Pro-Arg-Lys-Tyr | Met-Thr-Lys-Pro-Arg-Lys-Tyr | Met-Thr-Lys-Pro-Arg-Lys-Tyr | 1445 |
| Met(O)-Thr-Lys-Pro-Tyr | Met(O)-Thr-Lys-Pro-Tyr | Met(O)-Thr-Lys-Pro-Tyr | 1446 |
| Met(O)-Thr-Lys-Pro-Arg-Tyr | Met(O)-Thr-Lys-Pro-Arg-Tyr | Met(O)-Thr-Lys-Pro-Arg-Tyr | 1447 |
| Met(O)-Thr-Lys-Pro-Phe-Tyr | Met(O)-Thr-Lys-Pro-Phe-Tyr | Met(O)-Thr-Lys-Pro-Phe-Tyr | 1448 |
| Met(O)-Thr-Lys-Pro-Tyr-Tyr | Met(O)-Thr-Lys-Pro-Tyr-Tyr | Met(O)-Thr-Lys-Pro-Tyr-Tyr | 1449 |

TABLE 1-continued

| X-OH | X-OCH$_3$ | X-NH$_2$ | SEQ ID NO |
|---|---|---|---|
| Met(O)-Thr-Lys-Pro-Gly-Tyr | Met(O)-Thr-Lys-Pro-Gly-Tyr | Met(O)-Thr-Lys-Pro-Gly-Tyr | 1450 |
| Met(O)-Thr-Lys-Pro-His-Tyr | Met(O)-Thr-Lys-Pro-His-Tyr | Met(O)-Thr-Lys-Pro-His-Tyr | 1451 |
| Met(O)-Thr-Lys-Pro-Lys-Tyr | Met(O)-Thr-Lys-Pro-Lys-Tyr | Met(O)-Thr-Lys-Pro-Lys-Tyr | 1452 |
| Met(O)-Thr-Lys-Pro-Gly-Tyr | Met(O)-Thr-Lys-Pro-Gly-Tyr | Met(O)-Thr-Lys-Pro-Gly-Tyr | 1453 |
| Met(O)-Thr-Lys-Pro-Gly-Arg-Tyr | Met(O)-Thr-Lys-Pro-Gly-Arg-Tyr | Met(O)-Thr-Lys-Pro-Gly-Arg-Tyr | 1454 |
| Met(O)-Thr-Lys-Pro-Gly-Phe-Tyr | Met(O)-Thr-Lys-Pro-Gly-Phe-Tyr | Met(O)-Thr-Lys-Pro-Gly-Phe-Tyr | 1455 |
| Met(O)-Thr-Lys-Pro-Gly-Tyr-Tyr | Met(O)-Thr-Lys-Pro-Gly-Tyr-Tyr | Met(O)-Thr-Lys-Pro-Gly-Tyr-Tyr | 1456 |
| Met(O)-Thr-Lys-Pro-Gly-His-Tyr | Met(O)-Thr-Lys-Pro-Gly-His-Tyr | Met(O)-Thr-Lys-Pro-Gly-His-Tyr | 1457 |
| Met(O)-Thr-Lys-Pro-Gly-Pro-Tyr | Met(O)-Thr-Lys-Pro-Gly-Pro-Tyr | Met(O)-Thr-Lys-Pro-Gly-Pro-Tyr | 1458 |
| Met(O)-Thr-Lys-Pro-Gly-Lys-Tyr | Met(O)-Thr-Lys-Pro-Gly-Lys-Tyr | Met(O)-Thr-Lys-Pro-Gly-Lys-Tyr | 1459 |
| Met(O)-Thr-Lys-Pro-Asp-Tyr | Met(O)-Thr-Lys-Pro-Asp-Tyr | Met(O)-Thr-Lys-Pro-Asp-Tyr | 1460 |
| Met(O)-Thr-Lys-Pro-Asp-Arg-Tyr | Met(O)-Thr-Lys-Pro-Asp-Arg-Tyr | Met(O)-Thr-Lys-Pro-Asp-Arg-Tyr | 1461 |
| Met(O)-Thr-Lys-Pro-Asp-Phe-Tyr | Met(O)-Thr-Lys-Pro-Asp-Phe-Tyr | Met(O)-Thr-Lys-Pro-Asp-Phe-Tyr | 1462 |
| Met(O)-Thr-Lys-Pro-Asp-Tyr-Tyr | Met(O)-Thr-Lys-Pro-Asp-Tyr-Tyr | Met(O)-Thr-Lys-Pro-Asp-Tyr-Tyr | 1463 |
| Met(O)-Thr-Lys-Pro-Asp-His-Tyr | Met(O)-Thr-Lys-Pro-Asp-His-Tyr | Met(O)-Thr-Lys-Pro-Asp-His-Tyr | 1464 |
| Met(O)-Thr-Lys-Pro-Asp-Pro-Tyr | Met(O)-Thr-Lys-Pro-Asp-Pro-Tyr | Met(O)-Thr-Lys-Pro-Asp-Pro-Tyr | 1465 |
| Met(O)-Thr-Lys-Pro-Asp-Lys-Tyr | Met(O)-Thr-Lys-Pro-Asp-Lys-Tyr | Met(O)-Thr-Lys-Pro-Asp-Lys-Tyr | 1466 |
| Met(O)-Thr-Lys-Pro-Trp-Tyr | Met(O)-Thr-Lys-Pro-Trp-Tyr | Met(O)-Thr-Lys-Pro-Trp-Tyr | 1467 |
| Met(O)-Thr-Lys-Pro-Trp-Arg-Tyr | Met(O)-Thr-Lys-Pro-Trp-Arg-Tyr | Met(O)-Thr-Lys-Pro-Trp-Arg-Tyr | 1468 |
| Met(O)-Thr-Lys-Pro-Trp-Phe-Tyr | Met(O)-Thr-Lys-Pro-Trp-Phe-Tyr | Met(O)-Thr-Lys-Pro-Trp-Phe-Tyr | 1469 |
| Met(O)-Thr-Lys-Pro-Trp-Tyr-Tyr | Met(O)-Thr-Lys-Pro-Trp-Tyr-Tyr | Met(O)-Thr-Lys-Pro-Trp-Tyr-Tyr | 1470 |
| Met(O)-Thr-Lys-Pro-Trp-His-Tyr | Met(O)-Thr-Lys-Pro-Trp-His-Tyr | Met(O)-Thr-Lys-Pro-Trp-His-Tyr | 1471 |
| Met(O)-Thr-Lys-Pro-Trp-Pro-Tyr | Met(O)-Thr-Lys-Pro-Trp-Pro-Tyr | Met(O)-Thr-Lys-Pro-Trp-Pro-Tyr | 1472 |
| Met(O)-Thr-Lys-Pro-Trp-Lys-Tyr | Met(O)-Thr-Lys-Pro-Trp-Lys-Tyr | Met(O)-Thr-Lys-Pro-Trp-Lys-Tyr | 1473 |
| Met(O)-Thr-Lys-Pro-Gln-Tyr | Met(O)-Thr-Lys-Pro-Gln-Tyr | Met(O)-Thr-Lys-Pro-Gln-Tyr | 1474 |
| Met(O)-Thr-Lys-Pro-Gln-Arg-Tyr | Met(O)-Thr-Lys-Pro-Gln-Arg-Tyr | Met(O)-Thr-Lys-Pro-Gln-Arg-Tyr | 1475 |
| Met(O)-Thr-Lys-Pro-Gln-Phe-Tyr | Met(O)-Thr-Lys-Pro-Gln-Phe-Tyr | Met(O)-Thr-Lys-Pro-Gln-Phe-Tyr | 1476 |
| Met(O)-Thr-Lys-Pro-Gln-Tyr- | Met(O)-Thr-Lys-Pro-Gln-Tyr- | Met(O)-Thr-Lys-Pro-Gln-Tyr- | 1477 |

TABLE 1-continued

| X-OH | X-OCH₃ | X-NH₂ | SEQ ID NO |
|---|---|---|---|
| Tyr | Tyr | Tyr | |
| Met(O)-Thr-Lys-Pro-Gln-His-Tyr | Met(O)-Thr-Lys-Pro-Gln-His-Tyr | Met(O)-Thr-Lys-Pro-Gln-His-Tyr | 1478 |
| Met(O)-Thr-Lys-Pro-Gln-Pro-Tyr | Met(O)-Thr-Lys-Pro-Gln-Pro-Tyr | Met(O)-Thr-Lys-Pro-Gln-Pro-Tyr | 1479 |
| Met(O)-Thr-Lys-Pro-Gln-Lys-Tyr | Met(O)-Thr-Lys-Pro-Gln-Lys-Tyr | Met(O)-Thr-Lys-Pro-Gln-Lys-Tyr | 1480 |
| Met(O)-Thr-Lys-Pro-Asn-Tyr | Met(O)-Thr-Lys-Pro-Asn-Tyr | Met(O)-Thr-Lys-Pro-Asn-Tyr | 1481 |
| Met(O)-Thr-Lys-Pro-Asn-Arg-Tyr | Met(O)-Thr-Lys-Pro-Asn-Arg-Tyr | Met(O)-Thr-Lys-Pro-Asn-Arg-Tyr | 1482 |
| Met(O)-Thr-Lys-Pro-Asn-Phe-Tyr | Met(O)-Thr-Lys-Pro-Asn-Phe-Tyr | Met(O)-Thr-Lys-Pro-Asn-Phe-Tyr | 1483 |
| Met(O)-Thr-Lys-Pro-Asn-Tyr-Tyr | Met(O)-Thr-Lys-Pro-Asn-Tyr-Tyr | Met(O)-Thr-Lys-Pro-Asn-Tyr-Tyr | 1484 |
| Met(O)-Thr-Lys-Pro-Asn-His-Tyr | Met(O)-Thr-Lys-Pro-Asn-His-Tyr | Met(O)-Thr-Lys-Pro-Asn-His-Tyr | 1485 |
| Met(O)-Thr-Lys-Pro-Asn-Pro-Tyr | Met(O)-Thr-Lys-Pro-Asn-Pro-Tyr | Met(O)-Thr-Lys-Pro-Asn-Pro-Tyr | 1486 |
| Met(O)-Thr-Lys-Pro-Asn-Lys-Tyr | Met(O)-Thr-Lys-Pro-Asn-Lys-Tyr | Met(O)-Thr-Lys-Pro-Asn-Lys-Tyr | 1487 |
| Met(O)-Thr-Lys-Pro-Tyr-Tyr | Met(O)-Thr-Lys-Pro-Tyr-Tyr | Met(O)-Thr-Lys-Pro-Tyr-Tyr | 1488 |
| Met(O)-Thr-Lys-Pro-Tyr-Arg-Tyr | Met(O)-Thr-Lys-Pro-Tyr-Arg-Tyr | Met(O)-Thr-Lys-Pro-Tyr-Arg-Tyr | 1489 |
| Met(O)-Thr-Lys-Pro-Tyr-Phe-Tyr | Met(O)-Thr-Lys-Pro-Tyr-Phe-Tyr | Met(O)-Thr-Lys-Pro-Tyr-Phe-Tyr | 1490 |
| Met(O)-Thr-Lys-Pro-Tyr-Tyr-Tyr | Met(O)-Thr-Lys-Pro-Tyr-Tyr-Tyr | Met(O)-Thr-Lys-Pro-Tyr-Tyr-Tyr | 1491 |
| Met(O)-Thr-Lys-Pro-Tyr-His-Tyr | Met(O)-Thr-Lys-Pro-Tyr-His-Tyr | Met(O)-Thr-Lys-Pro-Tyr-His-Tyr | 1492 |
| Met(O)-Thr-Lys-Pro-Tyr-Pro-Tyr | Met(O)-Thr-Lys-Pro-Tyr-Pro-Tyr | Met(O)-Thr-Lys-Pro-Tyr-Pro-Tyr | 1493 |
| Met(O)-Thr-Lys-Pro-Tyr-Lys-Tyr | Met(O)-Thr-Lys-Pro-Tyr-Lys-Tyr | Met(O)-Thr-Lys-Pro-Tyr-Lys-Tyr | 1494 |
| Met(O)-Thr-Lys-Pro-Arg-Tyr | Met(O)-Thr-Lys-Pro-Arg-Tyr | Met(O)-Thr-Lys-Pro-Arg-Tyr | 1495 |
| Met(O)-Thr-Lys-Pro-Arg-Arg-Tyr | Met(O)-Thr-Lys-Pro-Arg-Arg-Tyr | Met(O)-Thr-Lys-Pro-Arg-Arg-Tyr | 1496 |
| Met(O)-Thr-Lys-Pro-Arg-Phe-Tyr | Met(O)-Thr-Lys-Pro-Arg-Phe-Tyr | Met(O)-Thr-Lys-Pro-Arg-Phe-Tyr | 1497 |
| Met(O)-Thr-Lys-Pro-Arg-Tyr-Tyr | Met(O)-Thr-Lys-Pro-Arg-Tyr-Tyr | Met(O)-Thr-Lys-Pro-Arg-Tyr-Tyr | 1498 |
| Met(O)-Thr-Lys-Pro-Arg-His-Tyr | Met(O)-Thr-Lys-Pro-Arg-His-Tyr | Met(O)-Thr-Lys-Pro-Arg-His-Tyr | 1499 |
| Met(O)-Thr-Lys-Pro-Arg-Pro-Tyr | Met(O)-Thr-Lys-Pro-Arg-Pro-Tyr | Met(O)-Thr-Lys-Pro-Arg-Pro-Tyr | 1500 |
| Met(O)-Thr-Lys-Pro-Arg-Lys-Tyr | Met(O)-Thr-Lys-Pro-Arg-Lys-Tyr | Met(O)-Thr-Lys-Pro-Arg-Lys-Tyr | 1501 |
| Thr-Thr-Lys-Pro-Tyr | Thr-Thr-Lys-Pro-Tyr | Thr-Thr-Lys-Pro-Tyr | 1502 |
| Thr-Thr-Lys-Pro-Arg-Tyr | Thr-Thr-Lys-Pro-Arg-Tyr | Thr-Thr-Lys-Pro-Arg-Tyr | 1503 |
| Thr-Thr-Lys-Pro-Phe-Tyr | Thr-Thr-Lys-Pro-Phe-Tyr | Thr-Thr-Lys-Pro-Phe-Tyr | 1504 |

TABLE 1-continued

| X-OH | X-OCH₃ | X-NH₂ | SEQ ID NO |
|---|---|---|---|
| Thr-Thr-Lys-Pro-Tyr-Tyr | Thr-Thr-Lys-Pro-Tyr-Tyr | Thr-Thr-Lys-Pro-Tyr-Tyr | 1505 |
| Thr-Thr-Lys-Pro-Gly-Tyr | Thr-Thr-Lys-Pro-Gly-Tyr | Thr-Thr-Lys-Pro-Gly-Tyr | 1506 |
| Thr-Thr-Lys-Pro-His-Tyr | Thr-Thr-Lys-Pro-His-Tyr | Thr-Thr-Lys-Pro-His-Tyr | 1507 |
| Thr-Thr-Lys-Pro-Lys-Tyr | Thr-Thr-Lys-Pro-Lys-Tyr | Thr-Thr-Lys-Pro-Lys-Tyr | 1508 |
| Thr-Thr-Lys-Pro-Gly-Tyr | Thr-Thr-Lys-Pro-Gly-Tyr | Thr-Thr-Lys-Pro-Gly-Tyr | 1509 |
| Thr-Thr-Lys-Pro-Gly-Arg-Tyr | Thr-Thr-Lys-Pro-Gly-Arg-Tyr | Thr-Thr-Lys-Pro-Gly-Arg-Tyr | 1510 |
| Thr-Thr-Lys-Pro-Gly-Phe-Tyr | Thr-Thr-Lys-Pro-Gly-Phe-Tyr | Thr-Thr-Lys-Pro-Gly-Phe-Tyr | 1511 |
| Thr-Thr-Lys-Pro-Gly-Tyr-Tyr | Thr-Thr-Lys-Pro-Gly-Tyr-Tyr | Thr-Thr-Lys-Pro-Gly-Tyr-Tyr | 1512 |
| Thr-Thr-Lys-Pro-Gly-His-Tyr | Thr-Thr-Lys-Pro-Gly-His-Tyr | Thr-Thr-Lys-Pro-Gly-His-Tyr | 1513 |
| Thr-Thr-Lys-Pro-Gly-Pro-Tyr | Thr-Thr-Lys-Pro-Gly-Pro-Tyr | Thr-Thr-Lys-Pro-Gly-Pro-Tyr | 1514 |
| Thr-Thr-Lys-Pro-Gly-Lys-Tyr | Thr-Thr-Lys-Pro-Gly-Lys-Tyr | Thr-Thr-Lys-Pro-Gly-Lys-Tyr | 1515 |
| Thr-Thr-Lys-Pro-Asp-Tyr | Thr-Thr-Lys-Pro-Asp-Tyr | Thr-Thr-Lys-Pro-Asp-Tyr | 1516 |
| Thr-Thr-Lys-Pro-Asp-Arg-Tyr | Thr-Thr-Lys-Pro-Asp-Arg-Tyr | Thr-Thr-Lys-Pro-Asp-Arg-Tyr | 1517 |
| Thr-Thr-Lys-Pro-Asp-Phe-Tyr | Thr-Thr-Lys-Pro-Asp-Phe-Tyr | Thr-Thr-Lys-Pro-Asp-Phe-Tyr | 1518 |
| Thr-Thr-Lys-Pro-Asp-Tyr-Tyr | Thr-Thr-Lys-Pro-Asp-Tyr-Tyr | Thr-Thr-Lys-Pro-Asp-Tyr-Tyr | 1519 |
| Thr-Thr-Lys-Pro-Asp-His-Tyr | Thr-Thr-Lys-Pro-Asp-His-Tyr | Thr-Thr-Lys-Pro-Asp-His-Tyr | 1520 |
| Thr-Thr-Lys-Pro-Asp-Pro-Tyr | Thr-Thr-Lys-Pro-Asp-Pro-Tyr | Thr-Thr-Lys-Pro-Asp-Pro-Tyr | 1521 |
| Thr-Thr-Lys-Pro-Asp-Lys-Tyr | Thr-Thr-Lys-Pro-Asp-Lys-Tyr | Thr-Thr-Lys-Pro-Asp-Lys-Tyr | 1522 |
| Thr-Thr-Lys-Pro-Trp-Tyr | Thr-Thr-Lys-Pro-Trp-Tyr | Thr-Thr-Lys-Pro-Trp-Tyr | 1523 |
| Thr-Thr-Lys-Pro-Trp-Arg-Tyr | Thr-Thr-Lys-Pro-Trp-Arg-Tyr | Thr-Thr-Lys-Pro-Trp-Arg-Tyr | 1524 |
| Thr-Thr-Lys-Pro-Trp-Phe-Tyr | Thr-Thr-Lys-Pro-Trp-Phe-Tyr | Thr-Thr-Lys-Pro-Trp-Phe-Tyr | 1525 |
| Thr-Thr-Lys-Pro-Trp-Tyr-Tyr | Thr-Thr-Lys-Pro-Trp-Tyr-Tyr | Thr-Thr-Lys-Pro-Trp-Tyr-Tyr | 1526 |
| Thr-Thr-Lys-Pro-Trp-His-Tyr | Thr-Thr-Lys-Pro-Trp-His-Tyr | Thr-Thr-Lys-Pro-Trp-His-Tyr | 1527 |
| Thr-Thr-Lys-Pro-Trp-Pro-Tyr | Thr-Thr-Lys-Pro-Trp-Pro-Tyr | Thr-Thr-Lys-Pro-Trp-Pro-Tyr | 1528 |
| Thr-Thr-Lys-Pro-Trp-Lys-Tyr | Thr-Thr-Lys-Pro-Trp-Lys-Tyr | Thr-Thr-Lys-Pro-Trp-Lys-Tyr | 1529 |
| Thr-Thr-Lys-Pro-Gln-Tyr | Thr-Thr-Lys-Pro-Gln-Tyr | Thr-Thr-Lys-Pro-Gln-Tyr | 1530 |
| Thr-Thr-Lys-Pro-Gln-Arg-Tyr | Thr-Thr-Lys-Pro-Gln-Arg-Tyr | Thr-Thr-Lys-Pro-Gln-Arg-Tyr | 1531 |
| Thr-Thr-Lys-Pro-Gln-Phe-Tyr | Thr-Thr-Lys-Pro-Gln-Phe-Tyr | Thr-Thr-Lys-Pro-Gln-Phe-Tyr | 1532 |
| Thr-Thr-Lys-Pro-Gln-Tyr-Tyr | Thr-Thr-Lys-Pro-Gln-Tyr-Tyr | Thr-Thr-Lys-Pro-Gln-Tyr-Tyr | 1533 |
| Thr-Thr-Lys-Pro-Gln-His-Tyr | Thr-Thr-Lys-Pro-Gln-His-Tyr | Thr-Thr-Lys-Pro-Gln-His-Tyr | 1534 |
| Thr-Thr-Lys-Pro-Gln-Pro-Tyr | Thr-Thr-Lys-Pro-Gln-Pro-Tyr | Thr-Thr-Lys-Pro-Gln-Pro-Tyr | 1535 |
| Thr-Thr-Lys-Pro-Gln-Lys-Tyr | Thr-Thr-Lys-Pro-Gln-Lys-Tyr | Thr-Thr-Lys-Pro-Gln-Lys-Tyr | 1536 |
| Thr-Thr-Lys-Pro-Asn-Tyr | Thr-Thr-Lys-Pro-Asn-Tyr | Thr-Thr-Lys-Pro-Asn-Tyr | 1537 |
| Thr-Thr-Lys-Pro-Asn-Arg-Tyr | Thr-Thr-Lys-Pro-Asn-Arg-Tyr | Thr-Thr-Lys-Pro-Asn-Arg-Tyr | 1538 |
| Thr-Thr-Lys-Pro-Asn-Phe-Tyr | Thr-Thr-Lys-Pro-Asn-Phe-Tyr | Thr-Thr-Lys-Pro-Asn-Phe-Tyr | 1539 |
| Thr-Thr-Lys-Pro-Asn-Tyr-Tyr | Thr-Thr-Lys-Pro-Asn-Tyr-Tyr | Thr-Thr-Lys-Pro-Asn-Tyr-Tyr | 1540 |
| Thr-Thr-Lys-Pro-Asn-His-Tyr | Thr-Thr-Lys-Pro-Asn-His-Tyr | Thr-Thr-Lys-Pro-Asn-His-Tyr | 1541 |
| Thr-Thr-Lys-Pro-Asn-Pro-Tyr | Thr-Thr-Lys-Pro-Asn-Pro-Tyr | Thr-Thr-Lys-Pro-Asn-Pro-Tyr | 1542 |

TABLE 1-continued

| X-OH | X-OCH₃ | X-NH₂ | SEQ ID NO |
|---|---|---|---|
| Thr-Thr-Lys-Pro-Asn-Lys-Tyr | Thr-Thr-Lys-Pro-Asn-Lys-Tyr | Thr-Thr-Lys-Pro-Asn-Lys-Tyr | 1543 |
| Thr-Thr-Lys-Pro-Tyr-Tyr | Thr-Thr-Lys-Pro-Tyr-Tyr | Thr-Thr-Lys-Pro-Tyr-Tyr | 1544 |
| Thr-Thr-Lys-Pro-Tyr-Arg-Tyr | Thr-Thr-Lys-Pro-Tyr-Arg-Tyr | Thr-Thr-Lys-Pro-Tyr-Arg-Tyr | 1545 |
| Thr-Thr-Lys-Pro-Tyr-Phe-Tyr | Thr-Thr-Lys-Pro-Tyr-Phe-Tyr | Thr-Thr-Lys-Pro-Tyr-Phe-Tyr | 1546 |
| Thr-Thr-Lys-Pro-Tyr-Tyr-Tyr | Thr-Thr-Lys-Pro-Tyr-Tyr-Tyr | Thr-Thr-Lys-Pro-Tyr-Tyr-Tyr | 1547 |
| Thr-Thr-Lys-Pro-Tyr-His-Tyr | Thr-Thr-Lys-Pro-Tyr-His-Tyr | Thr-Thr-Lys-Pro-Tyr-His-Tyr | 1548 |
| Thr-Thr-Lys-Pro-Tyr-Pro-Tyr | Thr-Thr-Lys-Pro-Tyr-Pro-Tyr | Thr-Thr-Lys-Pro-Tyr-Pro-Tyr | 1549 |
| Thr-Thr-Lys-Pro-Tyr-Lys-Tyr | Thr-Thr-Lys-Pro-Tyr-Lys-Tyr | Thr-Thr-Lys-Pro-Tyr-Lys-Tyr | 1550 |
| Thr-Thr-Lys-Pro-Arg-Tyr | Thr-Thr-Lys-Pro-Arg-Tyr | Thr-Thr-Lys-Pro-Arg-Tyr | 1551 |
| Thr-Thr-Lys-Pro-Arg-Arg-Tyr | Thr-Thr-Lys-Pro-Arg-Arg-Tyr | Thr-Thr-Lys-Pro-Arg-Arg-Tyr | 1552 |
| Thr-Thr-Lys-Pro-Arg-Phe-Tyr | Thr-Thr-Lys-Pro-Arg-Phe-Tyr | Thr-Thr-Lys-Pro-Arg-Phe-Tyr | 1553 |
| Thr-Thr-Lys-Pro-Arg-Tyr-Tyr | Thr-Thr-Lys-Pro-Arg-Tyr-Tyr | Thr-Thr-Lys-Pro-Arg-Tyr-Tyr | 1554 |
| Thr-Thr-Lys-Pro-Arg-His-Tyr | Thr-Thr-Lys-Pro-Arg-His-Tyr | Thr-Thr-Lys-Pro-Arg-His-Tyr | 1555 |
| Thr-Thr-Lys-Pro-Arg-Pro-Tyr | Thr-Thr-Lys-Pro-Arg-Pro-Tyr | Thr-Thr-Lys-Pro-Arg-Pro-Tyr | 1556 |
| Thr-Thr-Lys-Pro-Arg-Lys-Tyr | Thr-Thr-Lys-Pro-Arg-Lys-Tyr | Thr-Thr-Lys-Pro-Arg-Lys-Tyr | 1557 |
| Ala-Thr-Lys-Pro-Tyr | Ala-Thr-Lys-Pro-Tyr | Ala-Thr-Lys-Pro-Tyr | 1558 |
| Ala-Thr-Lys-Pro-Arg-Tyr | Ala-Thr-Lys-Pro-Arg-Tyr | Ala-Thr-Lys-Pro-Arg-Tyr | 1559 |
| Ala-Thr-Lys-Pro-Phe-Tyr | Ala-Thr-Lys-Pro-Phe-Tyr | Ala-Thr-Lys-Pro-Phe-Tyr | 1560 |
| Ala-Thr-Lys-Pro-Tyr-Tyr | Ala-Thr-Lys-Pro-Tyr-Tyr | Ala-Thr-Lys-Pro-Tyr-Tyr | 1561 |
| Ala-Thr-Lys-Pro-Gly-Tyr | Ala-Thr-Lys-Pro-Gly-Tyr | Ala-Thr-Lys-Pro-Gly-Tyr | 1562 |
| Ala-Thr-Lys-Pro-His-Tyr | Ala-Thr-Lys-Pro-His-Tyr | Ala-Thr-Lys-Pro-His-Tyr | 1563 |
| Ala-Thr-Lys-Pro-Lys-Tyr | Ala-Thr-Lys-Pro-Lys-Tyr | Ala-Thr-Lys-Pro-Lys-Tyr | 1564 |
| Ala-Thr-Lys-Pro-Gly-Tyr | Ala-Thr-Lys-Pro-Gly-Tyr | Ala-Thr-Lys-Pro-Gly-Tyr | 1565 |
| Ala-Thr-Lys-Pro-Gly-Arg-Tyr | Ala-Thr-Lys-Pro-Gly-Arg-Tyr | Ala-Thr-Lys-Pro-Gly-Arg-Tyr | 1566 |
| Ala-Thr-Lys-Pro-Gly-Phe-Tyr | Ala-Thr-Lys-Pro-Gly-Phe-Tyr | Ala-Thr-Lys-Pro-Gly-Phe-Tyr | 1567 |
| Ala-Thr-Lys-Pro-Gly-Tyr-Tyr | Ala-Thr-Lys-Pro-Gly-Tyr-Tyr | Ala-Thr-Lys-Pro-Gly-Tyr-Tyr | 1568 |
| Ala-Thr-Lys-Pro-Gly-His-Tyr | Ala-Thr-Lys-Pro-Gly-His-Tyr | Ala-Thr-Lys-Pro-Gly-His-Tyr | 1569 |
| Ala-Thr-Lys-Pro-Gly-Pro-Tyr | Ala-Thr-Lys-Pro-Gly-Pro-Tyr | Ala-Thr-Lys-Pro-Gly-Pro-Tyr | 1570 |
| Ala-Thr-Lys-Pro-Gly-Lys-Tyr | Ala-Thr-Lys-Pro-Gly-Lys-Tyr | Ala-Thr-Lys-Pro-Gly-Lys-Tyr | 1571 |
| Ala-Thr-Lys-Pro-Asp-Tyr | Ala-Thr-Lys-Pro-Asp-Tyr | Ala-Thr-Lys-Pro-Asp-Tyr | 1572 |
| Ala-Thr-Lys-Pro-Asp-Arg-Tyr | Ala-Thr-Lys-Pro-Asp-Arg-Tyr | Ala-Thr-Lys-Pro-Asp-Arg-Tyr | 1573 |
| Ala-Thr-Lys-Pro-Asp-Phe-Tyr | Ala-Thr-Lys-Pro-Asp-Phe-Tyr | Ala-Thr-Lys-Pro-Asp-Phe-Tyr | 1574 |
| Ala-Thr-Lys-Pro-Asp-Tyr-Tyr | Ala-Thr-Lys-Pro-Asp-Tyr-Tyr | Ala-Thr-Lys-Pro-Asp-Tyr-Tyr | 1575 |
| Ala-Thr-Lys-Pro-Asp-His-Tyr | Ala-Thr-Lys-Pro-Asp-His-Tyr | Ala-Thr-Lys-Pro-Asp-His-Tyr | 1576 |
| Ala-Thr-Lys-Pro-Asp-Pro-Tyr | Ala-Thr-Lys-Pro-Asp-Pro-Tyr | Ala-Thr-Lys-Pro-Asp-Pro-Tyr | 1577 |
| Ala-Thr-Lys-Pro-Asp-Lys-Tyr | Ala-Thr-Lys-Pro-Asp-Lys-Tyr | Ala-Thr-Lys-Pro-Asp-Lys-Tyr | 1578 |
| Ala-Thr-Lys-Pro-Trp-Tyr | Ala-Thr-Lys-Pro-Trp-Tyr | Ala-Thr-Lys-Pro-Trp-Tyr | 1579 |
| Ala-Thr-Lys-Pro-Trp-Arg-Tyr | Ala-Thr-Lys-Pro-Trp-Arg-Tyr | Ala-Thr-Lys-Pro-Trp-Arg-Tyr | 1580 |

TABLE 1-continued

| X-OH | X-OCH₃ | X-NH₂ | SEQ ID NO |
|---|---|---|---|
| Ala-Thr-Lys-Pro-Trp-Phe-Tyr | Ala-Thr-Lys-Pro-Trp-Phe-Tyr | Ala-Thr-Lys-Pro-Trp-Phe-Tyr | 1581 |
| Ala-Thr-Lys-Pro-Trp-Tyr-Tyr | Ala-Thr-Lys-Pro-Trp-Tyr-Tyr | Ala-Thr-Lys-Pro-Trp-Tyr-Tyr | 1582 |
| Ala-Thr-Lys-Pro-Trp-His-Tyr | Ala-Thr-Lys-Pro-Trp-His-Tyr | Ala-Thr-Lys-Pro-Trp-His-Tyr | 1583 |
| Ala-Thr-Lys-Pro-Trp-Pro-Tyr | Ala-Thr-Lys-Pro-Trp-Pro-Tyr | Ala-Thr-Lys-Pro-Trp-Pro-Tyr | 1584 |
| Ala-Thr-Lys-Pro-Trp-Lys-Tyr | Ala-Thr-Lys-Pro-Trp-Lys-Tyr | Ala-Thr-Lys-Pro-Trp-Lys-Tyr | 1585 |
| Ala-Thr-Lys-Pro-Gln-Tyr | Ala-Thr-Lys-Pro-Gln-Tyr | Ala-Thr-Lys-Pro-Gln-Tyr | 1586 |
| Ala-Thr-Lys-Pro-Gln-Arg-Tyr | Ala-Thr-Lys-Pro-Gln-Arg-Tyr | Ala-Thr-Lys-Pro-Gln-Arg-Tyr | 1587 |
| Ala-Thr-Lys-Pro-Gln-Phe-Tyr | Ala-Thr-Lys-Pro-Gln-Phe-Tyr | Ala-Thr-Lys-Pro-Gln-Phe-Tyr | 1588 |
| Ala-Thr-Lys-Pro-Gln-Tyr-Tyr | Ala-Thr-Lys-Pro-Gln-Tyr-Tyr | Ala-Thr-Lys-Pro-Gln-Tyr-Tyr | 1589 |
| Ala-Thr-Lys-Pro-Gln-His-Tyr | Ala-Thr-Lys-Pro-Gln-His-Tyr | Ala-Thr-Lys-Pro-Gln-His-Tyr | 1590 |
| Ala-Thr-Lys-Pro-Gln-Pro-Tyr | Ala-Thr-Lys-Pro-Gln-Pro-Tyr | Ala-Thr-Lys-Pro-Gln-Pro-Tyr | 1591 |
| Ala-Thr-Lys-Pro-Gln-Lys-Tyr | Ala-Thr-Lys-Pro-Gln-Lys-Tyr | Ala-Thr-Lys-Pro-Gln-Lys-Tyr | 1592 |
| Ala-Thr-Lys-Pro-Asn-Tyr | Ala-Thr-Lys-Pro-Asn-Tyr | Ala-Thr-Lys-Pro-Asn-Tyr | 1593 |
| Ala-Thr-Lys-Pro-Asn-Arg-Tyr | Ala-Thr-Lys-Pro-Asn-Arg-Tyr | Ala-Thr-Lys-Pro-Asn-Arg-Tyr | 1594 |
| Ala-Thr-Lys-Pro-Asn-Phe-Tyr | Ala-Thr-Lys-Pro-Asn-Phe-Tyr | Ala-Thr-Lys-Pro-Asn-Phe-Tyr | 1595 |
| Ala-Thr-Lys-Pro-Asn-Tyr-Tyr | Ala-Thr-Lys-Pro-Asn-Tyr-Tyr | Ala-Thr-Lys-Pro-Asn-Tyr-Tyr | 1596 |
| Ala-Thr-Lys-Pro-Asn-His-Tyr | Ala-Thr-Lys-Pro-Asn-His-Tyr | Ala-Thr-Lys-Pro-Asn-His-Tyr | 1597 |
| Ala-Thr-Lys-Pro-Asn-Pro-Tyr | Ala-Thr-Lys-Pro-Asn-Pro-Tyr | Ala-Thr-Lys-Pro-Asn-Pro-Tyr | 1598 |
| Ala-Thr-Lys-Pro-Asn-Lys-Tyr | Ala-Thr-Lys-Pro-Asn-Lys-Tyr | Ala-Thr-Lys-Pro-Asn-Lys-Tyr | 1599 |
| Ala-Thr-Lys-Pro-Tyr-Tyr | Ala-Thr-Lys-Pro-Tyr-Tyr | Ala-Thr-Lys-Pro-Tyr-Tyr | 1600 |
| Ala-Thr-Lys-Pro-Tyr-Arg-Tyr | Ala-Thr-Lys-Pro-Tyr-Arg-Tyr | Ala-Thr-Lys-Pro-Tyr-Arg-Tyr | 1601 |
| Ala-Thr-Lys-Pro-Tyr-Phe-Tyr | Ala-Thr-Lys-Pro-Tyr-Phe-Tyr | Ala-Thr-Lys-Pro-Tyr-Phe-Tyr | 1602 |
| Ala-Thr-Lys-Pro-Tyr-Tyr-Tyr | Ala-Thr-Lys-Pro-Tyr-Tyr-Tyr | Ala-Thr-Lys-Pro-Tyr-Tyr-Tyr | 1603 |
| Ala-Thr-Lys-Pro-Tyr-His-Tyr | Ala-Thr-Lys-Pro-Tyr-His-Tyr | Ala-Thr-Lys-Pro-Tyr-His-Tyr | 1604 |
| Ala-Thr-Lys-Pro-Tyr-Pro-Tyr | Ala-Thr-Lys-Pro-Tyr-Pro-Tyr | Ala-Thr-Lys-Pro-Tyr-Pro-Tyr | 1605 |
| Ala-Thr-Lys-Pro-Tyr-Lys-Tyr | Ala-Thr-Lys-Pro-Tyr-Lys-Tyr | Ala-Thr-Lys-Pro-Tyr-Lys-Tyr | 1606 |
| Ala-Thr-Lys-Pro-Arg-Tyr | Ala-Thr-Lys-Pro-Arg-Tyr | Ala-Thr-Lys-Pro-Arg-Tyr | 1607 |
| Ala-Thr-Lys-Pro-Arg-Arg-Tyr | Ala-Thr-Lys-Pro-Arg-Arg-Tyr | Ala-Thr-Lys-Pro-Arg-Arg-Tyr | 1608 |
| Ala-Thr-Lys-Pro-Arg-Phe-Tyr | Ala-Thr-Lys-Pro-Arg-Phe-Tyr | Ala-Thr-Lys-Pro-Arg-Phe-Tyr | 1609 |
| Ala-Thr-Lys-Pro-Arg-Tyr-Tyr | Ala-Thr-Lys-Pro-Arg-Tyr-Tyr | Ala-Thr-Lys-Pro-Arg-Tyr-Tyr | 1610 |
| Ala-Thr-Lys-Pro-Arg-His-Tyr | Ala-Thr-Lys-Pro-Arg-His-Tyr | Ala-Thr-Lys-Pro-Arg-His-Tyr | 1611 |
| Ala-Thr-Lys-Pro-Arg-Pro-Tyr | Ala-Thr-Lys-Pro-Arg-Pro-Tyr | Ala-Thr-Lys-Pro-Arg-Pro-Tyr | 1612 |
| Ala-Thr-Lys-Pro-Arg-Lys-Tyr | Ala-Thr-Lys-Pro-Arg-Lys-Tyr | Ala-Thr-Lys-Pro-Arg-Lys-Tyr | 1613 |
| His-Thr-Lys-Pro-Tyr | His-Thr-Lys-Pro-Tyr | His-Thr-Lys-Pro-Tyr | 1614 |
| His-Thr-Lys-Pro-Arg-Tyr | His-Thr-Lys-Pro-Arg-Tyr | His-Thr-Lys-Pro-Arg-Tyr | 1615 |
| His-Thr-Lys-Pro-Phe-Tyr | His-Thr-Lys-Pro-Phe-Tyr | His-Thr-Lys-Pro-Phe-Tyr | 1616 |
| His-Thr-Lys-Pro-Tyr-Tyr | His-Thr-Lys-Pro-Tyr-Tyr | His-Thr-Lys-Pro-Tyr-Tyr | 1617 |
| His-Thr-Lys-Pro-Gly-Tyr | His-Thr-Lys-Pro-Gly-Tyr | His-Thr-Lys-Pro-Gly-Tyr | 1618 |

TABLE 1-continued

| X-OH | X-OCH₃ | X-NH₂ | SEQ ID NO |
|---|---|---|---|
| His-Thr-Lys-Pro-His-Tyr | His-Thr-Lys-Pro-His-Tyr | His-Thr-Lys-Pro-His-Tyr | 1619 |
| His-Thr-Lys-Pro-Lys-Tyr | His-Thr-Lys-Pro-Lys-Tyr | His-Thr-Lys-Pro-Lys-Tyr | 1620 |
| His-Thr-Lys-Pro-Gly-Tyr | His-Thr-Lys-Pro-Gly-Tyr | His-Thr-Lys-Pro-Gly-Tyr | 1621 |
| His-Thr-Lys-Pro-Gly-Arg-Tyr | His-Thr-Lys-Pro-Gly-Arg-Tyr | His-Thr-Lys-Pro-Gly-Arg-Tyr | 1622 |
| His-Thr-Lys-Pro-Gly-Phe-Tyr | His-Thr-Lys-Pro-Gly-Phe-Tyr | His-Thr-Lys-Pro-Gly-Phe-Tyr | 1623 |
| His-Thr-Lys-Pro-Gly-Tyr-Tyr | His-Thr-Lys-Pro-Gly-Tyr-Tyr | His-Thr-Lys-Pro-Gly-Tyr-Tyr | 1624 |
| His-Thr-Lys-Pro-Gly-His-Tyr | His-Thr-Lys-Pro-Gly-His-Tyr | His-Thr-Lys-Pro-Gly-His-Tyr | 1625 |
| His-Thr-Lys-Pro-Gly-Pro-Tyr | His-Thr-Lys-Pro-Gly-Pro-Tyr | His-Thr-Lys-Pro-Gly-Pro-Tyr | 1626 |
| His-Thr-Lys-Pro-Gly-Lys-Tyr | His-Thr-Lys-Pro-Gly-Lys-Tyr | His-Thr-Lys-Pro-Gly-Lys-Tyr | 1627 |
| His-Thr-Lys-Pro-Asp-Tyr | His-Thr-Lys-Pro-Asp-Tyr | His-Thr-Lys-Pro-Asp-Tyr | 1628 |
| His-Thr-Lys-Pro-Asp-Arg-Tyr | His-Thr-Lys-Pro-Asp-Arg-Tyr | His-Thr-Lys-Pro-Asp-Arg-Tyr | 1629 |
| His-Thr-Lys-Pro-Asp-Phe-Tyr | His-Thr-Lys-Pro-Asp-Phe-Tyr | His-Thr-Lys-Pro-Asp-Phe-Tyr | 1630 |
| His-Thr-Lys-Pro-Asp-Tyr-Tyr | His-Thr-Lys-Pro-Asp-Tyr-Tyr | His-Thr-Lys-Pro-Asp-Tyr-Tyr | 1631 |
| His-Thr-Lys-Pro-Asp-His-Tyr | His-Thr-Lys-Pro-Asp-His-Tyr | His-Thr-Lys-Pro-Asp-His-Tyr | 1632 |
| His-Thr-Lys-Pro-Asp-Pro-Tyr | His-Thr-Lys-Pro-Asp-Pro-Tyr | His-Thr-Lys-Pro-Asp-Pro-Tyr | 1633 |
| His-Thr-Lys-Pro-Asp-Lys-Tyr | His-Thr-Lys-Pro-Asp-Lys-Tyr | His-Thr-Lys-Pro-Asp-Lys-Tyr | 1634 |
| His-Thr-Lys-Pro-Trp-Tyr | His-Thr-Lys-Pro-Trp-Tyr | His-Thr-Lys-Pro-Trp-Tyr | 1635 |
| His-Thr-Lys-Pro-Trp-Arg-Tyr | His-Thr-Lys-Pro-Trp-Arg-Tyr | His-Thr-Lys-Pro-Trp-Arg-Tyr | 1636 |
| His-Thr-Lys-Pro-Trp-Phe-Tyr | His-Thr-Lys-Pro-Trp-Phe-Tyr | His-Thr-Lys-Pro-Trp-Phe-Tyr | 1637 |
| His-Thr-Lys-Pro-Trp-Tyr-Tyr | His-Thr-Lys-Pro-Trp-Tyr-Tyr | His-Thr-Lys-Pro-Trp-Tyr-Tyr | 1638 |
| His-Thr-Lys-Pro-Trp-His-Tyr | His-Thr-Lys-Pro-Trp-His-Tyr | His-Thr-Lys-Pro-Trp-His-Tyr | 1639 |
| His-Thr-Lys-Pro-Trp-Pro-Tyr | His-Thr-Lys-Pro-Trp-Pro-Tyr | His-Thr-Lys-Pro-Trp-Pro-Tyr | 1640 |
| His-Thr-Lys-Pro-Trp-Lys-Tyr | His-Thr-Lys-Pro-Trp-Lys-Tyr | His-Thr-Lys-Pro-Trp-Lys-Tyr | 1641 |
| His-Thr-Lys-Pro-Gln-Tyr | His-Thr-Lys-Pro-Gln-Tyr | His-Thr-Lys-Pro-Gln-Tyr | 1642 |
| His-Thr-Lys-Pro-Gln-Arg-Tyr | His-Thr-Lys-Pro-Gln-Arg-Tyr | His-Thr-Lys-Pro-Gln-Arg-Tyr | 1643 |
| His-Thr-Lys-Pro-Gln-Phe-Tyr | His-Thr-Lys-Pro-Gln-Phe-Tyr | His-Thr-Lys-Pro-Gln-Phe-Tyr | 1644 |
| His-Thr-Lys-Pro-Gln-Tyr-Tyr | His-Thr-Lys-Pro-Gln-Tyr-Tyr | His-Thr-Lys-Pro-Gln-Tyr-Tyr | 1645 |
| His-Thr-Lys-Pro-Gln-His-Tyr | His-Thr-Lys-Pro-Gln-His-Tyr | His-Thr-Lys-Pro-Gln-His-Tyr | 1646 |
| His-Thr-Lys-Pro-Gln-Pro-Tyr | His-Thr-Lys-Pro-Gln-Pro-Tyr | His-Thr-Lys-Pro-Gln-Pro-Tyr | 1647 |
| His-Thr-Lys-Pro-Gln-Lys-Tyr | His-Thr-Lys-Pro-Gln-Lys-Tyr | His-Thr-Lys-Pro-Gln-Lys-Tyr | 1648 |
| His-Thr-Lys-Pro-Asn-Tyr | His-Thr-Lys-Pro-Asn-Tyr | His-Thr-Lys-Pro-Asn-Tyr | 1649 |
| His-Thr-Lys-Pro-Asn-Arg-Tyr | His-Thr-Lys-Pro-Asn-Arg-Tyr | His-Thr-Lys-Pro-Asn-Arg-Tyr | 1650 |
| His-Thr-Lys-Pro-Asn-Phe-Tyr | His-Thr-Lys-Pro-Asn-Phe-Tyr | His-Thr-Lys-Pro-Asn-Phe-Tyr | 1651 |
| His-Thr-Lys-Pro-Asn-Tyr-Tyr | His-Thr-Lys-Pro-Asn-Tyr-Tyr | His-Thr-Lys-Pro-Asn-Tyr-Tyr | 1652 |
| His-Thr-Lys-Pro-Asn-His-Tyr | His-Thr-Lys-Pro-Asn-His-Tyr | His-Thr-Lys-Pro-Asn-His-Tyr | 1653 |
| His-Thr-Lys-Pro-Asn-Pro-Tyr | His-Thr-Lys-Pro-Asn-Pro-Tyr | His-Thr-Lys-Pro-Asn-Pro-Tyr | 1654 |
| His-Thr-Lys-Pro-Asn-Lys-Tyr | His-Thr-Lys-Pro-Asn-Lys-Tyr | His-Thr-Lys-Pro-Asn-Lys-Tyr | 1655 |
| His-Thr-Lys-Pro-Tyr-Tyr | His-Thr-Lys-Pro-Tyr-Tyr | His-Thr-Lys-Pro-Tyr-Tyr | 1656 |

TABLE 1-continued

| X-OH | X-OCH₃ | X-NH₂ | SEQ ID NO |
|---|---|---|---|
| His-Thr-Lys-Pro-Tyr-Arg-Tyr | His-Thr-Lys-Pro-Tyr-Arg-Tyr | His-Thr-Lys-Pro-Tyr-Arg-Tyr | 1657 |
| His-Thr-Lys-Pro-Tyr-Phe-Tyr | His-Thr-Lys-Pro-Tyr-Phe-Tyr | His-Thr-Lys-Pro-Tyr-Phe-Tyr | 1658 |
| His-Thr-Lys-Pro-Tyr-Tyr-Tyr | His-Thr-Lys-Pro-Tyr-Tyr-Tyr | His-Thr-Lys-Pro-Tyr-Tyr-Tyr | 1659 |
| His-Thr-Lys-Pro-Tyr-His-Tyr | His-Thr-Lys-Pro-Tyr-His-Tyr | His-Thr-Lys-Pro-Tyr-His-Tyr | 1660 |
| His-Thr-Lys-Pro-Tyr-Pro-Tyr | His-Thr-Lys-Pro-Tyr-Pro-Tyr | His-Thr-Lys-Pro-Tyr-Pro-Tyr | 1661 |
| His-Thr-Lys-Pro-Tyr-Lys-Tyr | His-Thr-Lys-Pro-Tyr-Lys-Tyr | His-Thr-Lys-Pro-Tyr-Lys-Tyr | 1662 |
| His-Thr-Lys-Pro-Arg-Tyr | His-Thr-Lys-Pro-Arg-Tyr | His-Thr-Lys-Pro-Arg-Tyr | 1663 |
| His-Thr-Lys-Pro-Arg-Arg-Tyr | His-Thr-Lys-Pro-Arg-Arg-Tyr | His-Thr-Lys-Pro-Arg-Arg-Tyr | 1664 |
| His-Thr-Lys-Pro-Arg-Phe-Tyr | His-Thr-Lys-Pro-Arg-Phe-Tyr | His-Thr-Lys-Pro-Arg-Phe-Tyr | 1665 |
| His-Thr-Lys-Pro-Arg-Tyr-Tyr | His-Thr-Lys-Pro-Arg-Tyr-Tyr | His-Thr-Lys-Pro-Arg-Tyr-Tyr | 1666 |
| His-Thr-Lys-Pro-Arg-His-Tyr | His-Thr-Lys-Pro-Arg-His-Tyr | His-Thr-Lys-Pro-Arg-His-Tyr | 1667 |
| His-Thr-Lys-Pro-Arg-Pro-Tyr | His-Thr-Lys-Pro-Arg-Pro-Tyr | His-Thr-Lys-Pro-Arg-Pro-Tyr | 1668 |
| His-Thr-Lys-Pro-Arg-Lys-Tyr | His-Thr-Lys-Pro-Arg-Lys-Tyr | His-Thr-Lys-Pro-Arg-Lys-Tyr | 1669 |
| Lys-Thr-Lys-Pro-Tyr | Lys-Thr-Lys-Pro-Tyr | Lys-Thr-Lys-Pro-Tyr | 1670 |
| Lys-Thr-Lys-Pro-Arg-Tyr | Lys-Thr-Lys-Pro-Arg-Tyr | Lys-Thr-Lys-Pro-Arg-Tyr | 1671 |
| Lys-Thr-Lys-Pro-Phe-Tyr | Lys-Thr-Lys-Pro-Phe-Tyr | Lys-Thr-Lys-Pro-Phe-Tyr | 1672 |
| Lys-Thr-Lys-Pro-Tyr-Tyr | Lys-Thr-Lys-Pro-Tyr-Tyr | Lys-Thr-Lys-Pro-Tyr-Tyr | 1673 |
| Lys-Thr-Lys-Pro-Gly-Tyr | Lys-Thr-Lys-Pro-Gly-Tyr | Lys-Thr-Lys-Pro-Gly-Tyr | 1674 |
| Lys-Thr-Lys-Pro-His-Tyr | Lys-Thr-Lys-Pro-His-Tyr | Lys-Thr-Lys-Pro-His-Tyr | 1675 |
| Lys-Thr-Lys-Pro-Lys-Tyr | Lys-Thr-Lys-Pro-Lys-Tyr | Lys-Thr-Lys-Pro-Lys-Tyr | 1676 |
| Lys-Thr-Lys-Pro-Gly-Tyr | Lys-Thr-Lys-Pro-Gly-Tyr | Lys-Thr-Lys-Pro-Gly-Tyr | 1677 |
| Lys-Thr-Lys-Pro-Gly-Arg-Tyr | Lys-Thr-Lys-Pro-Gly-Arg-Tyr | Lys-Thr-Lys-Pro-Gly-Arg-Tyr | 1678 |
| Lys-Thr-Lys-Pro-Gly-Phe-Tyr | Lys-Thr-Lys-Pro-Gly-Phe-Tyr | Lys-Thr-Lys-Pro-Gly-Phe-Tyr | 1679 |
| Lys-Thr-Lys-Pro-Gly-Tyr-Tyr | Lys-Thr-Lys-Pro-Gly-Tyr-Tyr | Lys-Thr-Lys-Pro-Gly-Tyr-Tyr | 1680 |
| Lys-Thr-Lys-Pro-Gly-His-Tyr | Lys-Thr-Lys-Pro-Gly-His-Tyr | Lys-Thr-Lys-Pro-Gly-His-Tyr | 1681 |
| Lys-Thr-Lys-Pro-Gly-Pro-Tyr | Lys-Thr-Lys-Pro-Gly-Pro-Tyr | Lys-Thr-Lys-Pro-Gly-Pro-Tyr | 1682 |
| Lys-Thr-Lys-Pro-Gly-Lys-Tyr | Lys-Thr-Lys-Pro-Gly-Lys-Tyr | Lys-Thr-Lys-Pro-Gly-Lys-Tyr | 1683 |
| Lys-Thr-Lys-Pro-Asp-Tyr | Lys-Thr-Lys-Pro-Asp-Tyr | Lys-Thr-Lys-Pro-Asp-Tyr | 1684 |
| Lys-Thr-Lys-Pro-Asp-Arg-Tyr | Lys-Thr-Lys-Pro-Asp-Arg-Tyr | Lys-Thr-Lys-Pro-Asp-Arg-Tyr | 1685 |
| Lys-Thr-Lys-Pro-Asp-Phe-Tyr | Lys-Thr-Lys-Pro-Asp-Phe-Tyr | Lys-Thr-Lys-Pro-Asp-Phe-Tyr | 1686 |
| Lys-Thr-Lys-Pro-Asp-Tyr-Tyr | Lys-Thr-Lys-Pro-Asp-Tyr-Tyr | Lys-Thr-Lys-Pro-Asp-Tyr-Tyr | 1687 |
| Lys-Thr-Lys-Pro-Asp-His-Tyr | Lys-Thr-Lys-Pro-Asp-His-Tyr | Lys-Thr-Lys-Pro-Asp-His-Tyr | 1688 |
| Lys-Thr-Lys-Pro-Asp-Pro-Tyr | Lys-Thr-Lys-Pro-Asp-Pro-Tyr | Lys-Thr-Lys-Pro-Asp-Pro-Tyr | 1689 |
| Lys-Thr-Lys-Pro-Asp-Lys-Tyr | Lys-Thr-Lys-Pro-Asp-Lys-Tyr | Lys-Thr-Lys-Pro-Asp-Lys-Tyr | 1690 |
| Lys-Thr-Lys-Pro-Trp-Tyr | Lys-Thr-Lys-Pro-Trp-Tyr | Lys-Thr-Lys-Pro-Trp-Tyr | 1691 |
| Lys-Thr-Lys-Pro-Trp-Arg-Tyr | Lys-Thr-Lys-Pro-Trp-Arg-Tyr | Lys-Thr-Lys-Pro-Trp-Arg-Tyr | 1692 |
| Lys-Thr-Lys-Pro-Trp-Phe-Tyr | Lys-Thr-Lys-Pro-Trp-Phe-Tyr | Lys-Thr-Lys-Pro-Trp-Phe-Tyr | 1693 |
| Lys-Thr-Lys-Pro-Trp-Tyr-Tyr | Lys-Thr-Lys-Pro-Trp-Tyr-Tyr | Lys-Thr-Lys-Pro-Trp-Tyr-Tyr | 1694 |

TABLE 1-continued

| X-OH | X-OCH₃ | X-NH₂ | SEQ ID NO |
|---|---|---|---|
| Lys-Thr-Lys-Pro-Trp-His-Tyr | Lys-Thr-Lys-Pro-Trp-His-Tyr | Lys-Thr-Lys-Pro-Trp-His-Tyr | 1695 |
| Lys-Thr-Lys-Pro-Trp-Pro-Tyr | Lys-Thr-Lys-Pro-Trp-Pro-Tyr | Lys-Thr-Lys-Pro-Trp-Pro-Tyr | 1696 |
| Lys-Thr-Lys-Pro-Trp-Lys-Tyr | Lys-Thr-Lys-Pro-Trp-Lys-Tyr | Lys-Thr-Lys-Pro-Trp-Lys-Tyr | 1697 |
| Lys-Thr-Lys-Pro-Gln-Tyr | Lys-Thr-Lys-Pro-Gln-Tyr | Lys-Thr-Lys-Pro-Gln-Tyr | 1698 |
| Lys-Thr-Lys-Pro-Gln-Arg-Tyr | Lys-Thr-Lys-Pro-Gln-Arg-Tyr | Lys-Thr-Lys-Pro-Gln-Arg-Tyr | 1699 |
| Lys-Thr-Lys-Pro-Gln-Phe-Tyr | Lys-Thr-Lys-Pro-Gln-Phe-Tyr | Lys-Thr-Lys-Pro-Gln-Phe-Tyr | 1700 |
| Lys-Thr-Lys-Pro-Gln-Tyr-Tyr | Lys-Thr-Lys-Pro-Gln-Tyr-Tyr | Lys-Thr-Lys-Pro-Gln-Tyr-Tyr | 1701 |
| Lys-Thr-Lys-Pro-Gln-His-Tyr | Lys-Thr-Lys-Pro-Gln-His-Tyr | Lys-Thr-Lys-Pro-Gln-His-Tyr | 1702 |
| Lys-Thr-Lys-Pro-Gln-Pro-Tyr | Lys-Thr-Lys-Pro-Gln-Pro-Tyr | Lys-Thr-Lys-Pro-Gln-Pro-Tyr | 1703 |
| Lys-Thr-Lys-Pro-Gln-Lys-Tyr | Lys-Thr-Lys-Pro-Gln-Lys-Tyr | Lys-Thr-Lys-Pro-Gln-Lys-Tyr | 1704 |
| Lys-Thr-Lys-Pro-Asn-Tyr | Lys-Thr-Lys-Pro-Asn-Tyr | Lys-Thr-Lys-Pro-Asn-Tyr | 1705 |
| Lys-Thr-Lys-Pro-Asn-Arg-Tyr | Lys-Thr-Lys-Pro-Asn-Arg-Tyr | Lys-Thr-Lys-Pro-Asn-Arg-Tyr | 1706 |
| Lys-Thr-Lys-Pro-Asn-Phe-Tyr | Lys-Thr-Lys-Pro-Asn-Phe-Tyr | Lys-Thr-Lys-Pro-Asn-Phe-Tyr | 1707 |
| Lys-Thr-Lys-Pro-Asn-Tyr-Tyr | Lys-Thr-Lys-Pro-Asn-Tyr-Tyr | Lys-Thr-Lys-Pro-Asn-Tyr-Tyr | 1708 |
| Lys-Thr-Lys-Pro-Asn-His-Tyr | Lys-Thr-Lys-Pro-Asn-His-Tyr | Lys-Thr-Lys-Pro-Asn-His-Tyr | 1709 |
| Lys-Thr-Lys-Pro-Asn-Pro-Tyr | Lys-Thr-Lys-Pro-Asn-Pro-Tyr | Lys-Thr-Lys-Pro-Asn-Pro-Tyr | 1710 |
| Lys-Thr-Lys-Pro-Asn-Lys-Tyr | Lys-Thr-Lys-Pro-Asn-Lys-Tyr | Lys-Thr-Lys-Pro-Asn-Lys-Tyr | 1711 |
| Lys-Thr-Lys-Pro-Tyr-Tyr | Lys-Thr-Lys-Pro-Tyr-Tyr | Lys-Thr-Lys-Pro-Tyr-Tyr | 1712 |
| Lys-Thr-Lys-Pro-Tyr-Arg-Tyr | Lys-Thr-Lys-Pro-Tyr-Arg-Tyr | Lys-Thr-Lys-Pro-Tyr-Arg-Tyr | 1713 |
| Lys-Thr-Lys-Pro-Tyr-Phe-Tyr | Lys-Thr-Lys-Pro-Tyr-Phe-Tyr | Lys-Thr-Lys-Pro-Tyr-Phe-Tyr | 1714 |
| Lys-Thr-Lys-Pro-Tyr-Tyr-Tyr | Lys-Thr-Lys-Pro-Tyr-Tyr-Tyr | Lys-Thr-Lys-Pro-Tyr-Tyr-Tyr | 1715 |
| Lys-Thr-Lys-Pro-Tyr-His-Tyr | Lys-Thr-Lys-Pro-Tyr-His-Tyr | Lys-Thr-Lys-Pro-Tyr-His-Tyr | 1716 |
| Lys-Thr-Lys-Pro-Tyr-Pro-Tyr | Lys-Thr-Lys-Pro-Tyr-Pro-Tyr | Lys-Thr-Lys-Pro-Tyr-Pro-Tyr | 1717 |
| Lys-Thr-Lys-Pro-Tyr-Lys-Tyr | Lys-Thr-Lys-Pro-Tyr-Lys-Tyr | Lys-Thr-Lys-Pro-Tyr-Lys-Tyr | 1718 |
| Lys-Thr-Lys-Pro-Arg-Tyr | Lys-Thr-Lys-Pro-Arg-Tyr | Lys-Thr-Lys-Pro-Arg-Tyr | 1719 |
| Lys-Thr-Lys-Pro-Arg-Arg-Tyr | Lys-Thr-Lys-Pro-Arg-Arg-Tyr | Lys-Thr-Lys-Pro-Arg-Arg-Tyr | 1720 |
| Lys-Thr-Lys-Pro-Arg-Phe-Tyr | Lys-Thr-Lys-Pro-Arg-Phe-Tyr | Lys-Thr-Lys-Pro-Arg-Phe-Tyr | 1721 |
| Lys-Thr-Lys-Pro-Arg-Tyr-Tyr | Lys-Thr-Lys-Pro-Arg-Tyr-Tyr | Lys-Thr-Lys-Pro-Arg-Tyr-Tyr | 1722 |
| Lys-Thr-Lys-Pro-Arg-His-Tyr | Lys-Thr-Lys-Pro-Arg-His-Tyr | Lys-Thr-Lys-Pro-Arg-His-Tyr | 1723 |
| Lys-Thr-Lys-Pro-Arg-Pro-Tyr | Lys-Thr-Lys-Pro-Arg-Pro-Tyr | Lys-Thr-Lys-Pro-Arg-Pro-Tyr | 1724 |
| Lys-Thr-Lys-Pro-Arg-Lys-Tyr | Lys-Thr-Lys-Pro-Arg-Lys-Tyr | Lys-Thr-Lys-Pro-Arg-Lys-Tyr | 1725 |
| Gly-Thr-Lys-Pro-Tyr | Gly-Thr-Lys-Pro-Tyr | Gly-Thr-Lys-Pro-Tyr | 1726 |
| Gly-Thr-Lys-Pro-Arg-Tyr | Gly-Thr-Lys-Pro-Arg-Tyr | Gly-Thr-Lys-Pro-Arg-Tyr | 1727 |
| Gly-Thr-Lys-Pro-Phe-Tyr | Gly-Thr-Lys-Pro-Phe-Tyr | Gly-Thr-Lys-Pro-Phe-Tyr | 1728 |
| Gly-Thr-Lys-Pro-Tyr-Tyr | Gly-Thr-Lys-Pro-Tyr-Tyr | Gly-Thr-Lys-Pro-Tyr-Tyr | 1729 |
| Gly-Thr-Lys-Pro-Gly-Tyr | Gly-Thr-Lys-Pro-Gly-Tyr | Gly-Thr-Lys-Pro-Gly-Tyr | 1730 |
| Gly-Thr-Lys-Pro-His-Tyr | Gly-Thr-Lys-Pro-His-Tyr | Gly-Thr-Lys-Pro-His-Tyr | 1731 |
| Gly-Thr-Lys-Pro-Lys-Tyr | Gly-Thr-Lys-Pro-Lys-Tyr | Gly-Thr-Lys-Pro-Lys-Tyr | 1732 |

TABLE 1-continued

| X-OH | X-OCH₃ | X-NH₂ | SEQ ID NO |
|---|---|---|---|
| Gly-Thr-Lys-Pro-Gly-Tyr | Gly-Thr-Lys-Pro-Gly-Tyr | Gly-Thr-Lys-Pro-Gly-Tyr | 1733 |
| Gly-Thr-Lys-Pro-Gly-Arg-Tyr | Gly-Thr-Lys-Pro-Gly-Arg-Tyr | Gly-Thr-Lys-Pro-Gly-Arg-Tyr | 1734 |
| Gly-Thr-Lys-Pro-Gly-Phe-Tyr | Gly-Thr-Lys-Pro-Gly-Phe-Tyr | Gly-Thr-Lys-Pro-Gly-Phe-Tyr | 1735 |
| Gly-Thr-Lys-Pro-Gly-Tyr-Tyr | Gly-Thr-Lys-Pro-Gly-Tyr-Tyr | Gly-Thr-Lys-Pro-Gly-Tyr-Tyr | 1736 |
| Gly-Thr-Lys-Pro-Gly-His-Tyr | Gly-Thr-Lys-Pro-Gly-His-Tyr | Gly-Thr-Lys-Pro-Gly-His-Tyr | 1737 |
| Gly-Thr-Lys-Pro-Gly-Pro-Tyr | Gly-Thr-Lys-Pro-Gly-Pro-Tyr | Gly-Thr-Lys-Pro-Gly-Pro-Tyr | 1738 |
| Gly-Thr-Lys-Pro-Gly-Lys-Tyr | Gly-Thr-Lys-Pro-Gly-Lys-Tyr | Gly-Thr-Lys-Pro-Gly-Lys-Tyr | 1739 |
| Gly-Thr-Lys-Pro-Asp-Tyr | Gly-Thr-Lys-Pro-Asp-Tyr | Gly-Thr-Lys-Pro-Asp-Tyr | 1740 |
| Gly-Thr-Lys-Pro-Asp-Arg-Tyr | Gly-Thr-Lys-Pro-Asp-Arg-Tyr | Gly-Thr-Lys-Pro-Asp-Arg-Tyr | 1741 |
| Gly-Thr-Lys-Pro-Asp-Phe-Tyr | Gly-Thr-Lys-Pro-Asp-Phe-Tyr | Gly-Thr-Lys-Pro-Asp-Phe-Tyr | 1742 |
| Gly-Thr-Lys-Pro-Asp-Tyr-Tyr | Gly-Thr-Lys-Pro-Asp-Tyr-Tyr | Gly-Thr-Lys-Pro-Asp-Tyr-Tyr | 1743 |
| Gly-Thr-Lys-Pro-Asp-His-Tyr | Gly-Thr-Lys-Pro-Asp-His-Tyr | Gly-Thr-Lys-Pro-Asp-His-Tyr | 1744 |
| Gly-Thr-Lys-Pro-Asp-Pro-Tyr | Gly-Thr-Lys-Pro-Asp-Pro-Tyr | Gly-Thr-Lys-Pro-Asp-Pro-Tyr | 1745 |
| Gly-Thr-Lys-Pro-Asp-Lys-Tyr | Gly-Thr-Lys-Pro-Asp-Lys-Tyr | Gly-Thr-Lys-Pro-Asp-Lys-Tyr | 1746 |
| Gly-Thr-Lys-Pro-Trp-Tyr | Gly-Thr-Lys-Pro-Trp-Tyr | Gly-Thr-Lys-Pro-Trp-Tyr | 1747 |
| Gly-Thr-Lys-Pro-Trp-Arg-Tyr | Gly-Thr-Lys-Pro-Trp-Arg-Tyr | Gly-Thr-Lys-Pro-Trp-Arg-Tyr | 1748 |
| Gly-Thr-Lys-Pro-Trp-Phe-Tyr | Gly-Thr-Lys-Pro-Trp-Phe-Tyr | Gly-Thr-Lys-Pro-Trp-Phe-Tyr | 1749 |
| Gly-Thr-Lys-Pro-Trp-Tyr-Tyr | Gly-Thr-Lys-Pro-Trp-Tyr-Tyr | Gly-Thr-Lys-Pro-Trp-Tyr-Tyr | 1750 |
| Gly-Thr-Lys-Pro-Trp-His-Tyr | Gly-Thr-Lys-Pro-Trp-His-Tyr | Gly-Thr-Lys-Pro-Trp-His-Tyr | 1751 |
| Gly-Thr-Lys-Pro-Trp-Pro-Tyr | Gly-Thr-Lys-Pro-Trp-Pro-Tyr | Gly-Thr-Lys-Pro-Trp-Pro-Tyr | 1752 |
| Gly-Thr-Lys-Pro-Trp-Lys-Tyr | Gly-Thr-Lys-Pro-Trp-Lys-Tyr | Gly-Thr-Lys-Pro-Trp-Lys-Tyr | 1753 |
| Gly-Thr-Lys-Pro-Gln-Tyr | Gly-Thr-Lys-Pro-Gln-Tyr | Gly-Thr-Lys-Pro-Gln-Tyr | 1754 |
| Gly-Thr-Lys-Pro-Gln-Arg-Tyr | Gly-Thr-Lys-Pro-Gln-Arg-Tyr | Gly-Thr-Lys-Pro-Gln-Arg-Tyr | 1755 |
| Gly-Thr-Lys-Pro-Gln-Phe-Tyr | Gly-Thr-Lys-Pro-Gln-Phe-Tyr | Gly-Thr-Lys-Pro-Gln-Phe-Tyr | 1756 |
| Gly-Thr-Lys-Pro-Gln-Tyr-Tyr | Gly-Thr-Lys-Pro-Gln-Tyr-Tyr | Gly-Thr-Lys-Pro-Gln-Tyr-Tyr | 1757 |
| Gly-Thr-Lys-Pro-Gln-His-Tyr | Gly-Thr-Lys-Pro-Gln-His-Tyr | Gly-Thr-Lys-Pro-Gln-His-Tyr | 1758 |
| Gly-Thr-Lys-Pro-Gln-Pro-Tyr | Gly-Thr-Lys-Pro-Gln-Pro-Tyr | Gly-Thr-Lys-Pro-Gln-Pro-Tyr | 1759 |
| Gly-Thr-Lys-Pro-Gln-Lys-Tyr | Gly-Thr-Lys-Pro-Gln-Lys-Tyr | Gly-Thr-Lys-Pro-Gln-Lys-Tyr | 1760 |
| Gly-Thr-Lys-Pro-Asn-Tyr | Gly-Thr-Lys-Pro-Asn-Tyr | Gly-Thr-Lys-Pro-Asn-Tyr | 1761 |
| Gly-Thr-Lys-Pro-Asn-Arg-Tyr | Gly-Thr-Lys-Pro-Asn-Arg-Tyr | Gly-Thr-Lys-Pro-Asn-Arg-Tyr | 1762 |
| Gly-Thr-Lys-Pro-Asn-Phe-Tyr | Gly-Thr-Lys-Pro-Asn-Phe-Tyr | Gly-Thr-Lys-Pro-Asn-Phe-Tyr | 1763 |
| Gly-Thr-Lys-Pro-Asn-Tyr-Tyr | Gly-Thr-Lys-Pro-Asn-Tyr-Tyr | Gly-Thr-Lys-Pro-Asn-Tyr-Tyr | 1764 |
| Gly-Thr-Lys-Pro-Asn-His-Tyr | Gly-Thr-Lys-Pro-Asn-His-Tyr | Gly-Thr-Lys-Pro-Asn-His-Tyr | 1765 |
| Gly-Thr-Lys-Pro-Asn-Pro-Tyr | Gly-Thr-Lys-Pro-Asn-Pro-Tyr | Gly-Thr-Lys-Pro-Asn-Pro-Tyr | 1766 |
| Gly-Thr-Lys-Pro-Asn-Lys-Tyr | Gly-Thr-Lys-Pro-Asn-Lys-Tyr | Gly-Thr-Lys-Pro-Asn-Lys-Tyr | 1767 |
| Gly-Thr-Lys-Pro-Tyr-Tyr | Gly-Thr-Lys-Pro-Tyr-Tyr | Gly-Thr-Lys-Pro-Tyr-Tyr | 1768 |
| Gly-Thr-Lys-Pro-Tyr-Arg-Tyr | Gly-Thr-Lys-Pro-Tyr-Arg-Tyr | Gly-Thr-Lys-Pro-Tyr-Arg-Tyr | 1769 |
| Gly-Thr-Lys-Pro-Tyr-Phe-Tyr | Gly-Thr-Lys-Pro-Tyr-Phe-Tyr | Gly-Thr-Lys-Pro-Tyr-Phe-Tyr | 1770 |

TABLE 1-continued

| X-OH | X-OCH₃ | X-NH₂ | SEQ ID NO |
|---|---|---|---|
| Gly-Thr-Lys-Pro-Tyr-Tyr-Tyr | Gly-Thr-Lys-Pro-Tyr-Tyr-Tyr | Gly-Thr-Lys-Pro-Tyr-Tyr-Tyr | 1771 |
| Gly-Thr-Lys-Pro-Tyr-His-Tyr | Gly-Thr-Lys-Pro-Tyr-His-Tyr | Gly-Thr-Lys-Pro-Tyr-His-Tyr | 1772 |
| Gly-Thr-Lys-Pro-Tyr-Pro-Tyr | Gly-Thr-Lys-Pro-Tyr-Pro-Tyr | Gly-Thr-Lys-Pro-Tyr-Pro-Tyr | 1773 |
| Gly-Thr-Lys-Pro-Tyr-Lys-Tyr | Gly-Thr-Lys-Pro-Tyr-Lys-Tyr | Gly-Thr-Lys-Pro-Tyr-Lys-Tyr | 1774 |
| Gly-Thr-Lys-Pro-Arg-Tyr | Gly-Thr-Lys-Pro-Arg-Tyr | Gly-Thr-Lys-Pro-Arg-Tyr | 1775 |
| Gly-Thr-Lys-Pro-Arg-Arg-Tyr | Gly-Thr-Lys-Pro-Arg-Arg-Tyr | Gly-Thr-Lys-Pro-Arg-Arg-Tyr | 1776 |
| Gly-Thr-Lys-Pro-Arg-Phe-Tyr | Gly-Thr-Lys-Pro-Arg-Phe-Tyr | Gly-Thr-Lys-Pro-Arg-Phe-Tyr | 1777 |
| Gly-Thr-Lys-Pro-Arg-Tyr-Tyr | Gly-Thr-Lys-Pro-Arg-Tyr-Tyr | Gly-Thr-Lys-Pro-Arg-Tyr-Tyr | 1778 |
| Gly-Thr-Lys-Pro-Arg-His-Tyr | Gly-Thr-Lys-Pro-Arg-His-Tyr | Gly-Thr-Lys-Pro-Arg-His-Tyr | 1779 |
| Gly-Thr-Lys-Pro-Arg-Pro-Tyr | Gly-Thr-Lys-Pro-Arg-Pro-Tyr | Gly-Thr-Lys-Pro-Arg-Pro-Tyr | 1780 |
| Gly-Thr-Lys-Pro-Arg-Lys-Tyr | Gly-Thr-Lys-Pro-Arg-Lys-Tyr | Gly-Thr-Lys-Pro-Arg-Lys-Tyr | 1781 |
| Thr-Lys-Pro-Arg-Trp | Thr-Lys-Pro-Arg-Trp | Thr-Lys-Pro-Arg-Trp | 1782 |
| Thr-Lys-Pro-Phe-Trp | Thr-Lys-Pro-Phe-Trp | Thr-Lys-Pro-Phe-Trp | 1783 |
| Thr-Lys-Pro-Tyr-Trp | Thr-Lys-Pro-Tyr-Trp | Thr-Lys-Pro-Tyr-Trp | 1784 |
| Thr-Lys-Pro-Gly-Trp | Thr-Lys-Pro-Gly-Trp | Thr-Lys-Pro-Gly-Trp | 1785 |
| Thr-Lys-Pro-His-Trp | Thr-Lys-Pro-His-Trp | Thr-Lys-Pro-His-Trp | 1786 |
| Thr-Lys-Pro-Lys-Trp | Thr-Lys-Pro-Lys-Trp | Thr-Lys-Pro-Lys-Trp | 1787 |
| Thr-Lys-Pro-Gly-Trp | Thr-Lys-Pro-Gly-Trp | Thr-Lys-Pro-Gly-Trp | 1788 |
| Thr-Lys-Pro-Gly-Arg-Trp | Thr-Lys-Pro-Gly-Arg-Trp | Thr-Lys-Pro-Gly-Arg-Trp | 1789 |
| Thr-Lys-Pro-Gly-Phe-Trp | Thr-Lys-Pro-Gly-Phe-Trp | Thr-Lys-Pro-Gly-Phe-Trp | 1790 |
| Thr-Lys-Pro-Gly-Tyr-Trp | Thr-Lys-Pro-Gly-Tyr-Trp | Thr-Lys-Pro-Gly-Tyr-Trp | 1791 |
| Thr-Lys-Pro-Gly-His-Trp | Thr-Lys-Pro-Gly-His-Trp | Thr-Lys-Pro-Gly-His-Trp | 1792 |
| Thr-Lys-Pro-Gly-Pro-Trp | Thr-Lys-Pro-Gly-Pro-Trp | Thr-Lys-Pro-Gly-Pro-Trp | 1793 |
| Thr-Lys-Pro-Gly-Lys-Trp | Thr-Lys-Pro-Gly-Lys-Trp | Thr-Lys-Pro-Gly-Lys-Trp | 1794 |
| Thr-Lys-Pro-Asp-Trp | Thr-Lys-Pro-Asp-Trp | Thr-Lys-Pro-Asp-Trp | 1795 |
| Thr-Lys-Pro-Asp-Arg-Trp | Thr-Lys-Pro-Asp-Arg-Trp | Thr-Lys-Pro-Asp-Arg-Trp | 1796 |
| Thr-Lys-Pro-Asp-Phe-Trp | Thr-Lys-Pro-Asp-Phe-Trp | Thr-Lys-Pro-Asp-Phe-Trp | 1797 |
| Thr-Lys-Pro-Asp-Tyr-Trp | Thr-Lys-Pro-Asp-Tyr-Trp | Thr-Lys-Pro-Asp-Tyr-Trp | 1798 |
| Thr-Lys-Pro-Asp-His-Trp | Thr-Lys-Pro-Asp-His-Trp | Thr-Lys-Pro-Asp-His-Trp | 1799 |
| Thr-Lys-Pro-Asp-Pro-Trp | Thr-Lys-Pro-Asp-Pro-Trp | Thr-Lys-Pro-Asp-Pro-Trp | 1800 |
| Thr-Lys-Pro-Asp-Lys-Trp | Thr-Lys-Pro-Asp-Lys-Trp | Thr-Lys-Pro-Asp-Lys-Trp | 1801 |
| Thr-Lys-Pro-Trp-Trp | Thr-Lys-Pro-Trp-Trp | Thr-Lys-Pro-Trp-Trp | 1802 |
| Thr-Lys-Pro-Trp-Arg-Trp | Thr-Lys-Pro-Trp-Arg-Trp | Thr-Lys-Pro-Trp-Arg-Trp | 1803 |
| Thr-Lys-Pro-Trp-Phe-Trp | Thr-Lys-Pro-Trp-Phe-Trp | Thr-Lys-Pro-Trp-Phe-Trp | 1804 |
| Thr-Lys-Pro-Trp-Tyr-Trp | Thr-Lys-Pro-Trp-Tyr-Trp | Thr-Lys-Pro-Trp-Tyr-Trp | 1805 |
| Thr-Lys-Pro-Trp-His-Trp | Thr-Lys-Pro-Trp-His-Trp | Thr-Lys-Pro-Trp-His-Trp | 1806 |
| Thr-Lys-Pro-Trp-Pro-Trp | Thr-Lys-Pro-Trp-Pro-Trp | Thr-Lys-Pro-Trp-Pro-Trp | 1807 |
| Thr-Lys-Pro-Trp-Lys-Trp | Thr-Lys-Pro-Trp-Lys-Trp | Thr-Lys-Pro-Trp-Lys-Trp | 1808 |

TABLE 1-continued

| X-OH | X-OCH₃ | X-NH₂ | SEQ ID NO |
|---|---|---|---|
| Thr-Lys-Pro-Gln-Trp | Thr-Lys-Pro-Gln-Trp | Thr-Lys-Pro-Gln-Trp | 1809 |
| Thr-Lys-Pro-Gln-Arg-Trp | Thr-Lys-Pro-Gln-Arg-Trp | Thr-Lys-Pro-Gln-Arg-Trp | 1810 |
| Thr-Lys-Pro-Gln-Phe-Trp | Thr-Lys-Pro-Gln-Phe-Trp | Thr-Lys-Pro-Gln-Phe-Trp | 1811 |
| Thr-Lys-Pro-Gln-Tyr-Trp | Thr-Lys-Pro-Gln-Tyr-Trp | Thr-Lys-Pro-Gln-Tyr-Trp | 1812 |
| Thr-Lys-Pro-Gln-His-Trp | Thr-Lys-Pro-Gln-His-Trp | Thr-Lys-Pro-Gln-His-Trp | 1813 |
| Thr-Lys-Pro-Gln-Pro-Trp | Thr-Lys-Pro-Gln-Pro-Trp | Thr-Lys-Pro-Gln-Pro-Trp | 1814 |
| Thr-Lys-Pro-Gln-Lys-Trp | Thr-Lys-Pro-Gln-Lys-Trp | Thr-Lys-Pro-Gln-Lys-Trp | 1815 |
| Thr-Lys-Pro-Asn-Trp | Thr-Lys-Pro-Asn-Trp | Thr-Lys-Pro-Asn-Trp | 1816 |
| Thr-Lys-Pro-Asn-Arg-Trp | Thr-Lys-Pro-Asn-Arg-Trp | Thr-Lys-Pro-Asn-Arg-Trp | 1817 |
| Thr-Lys-Pro-Asn-Phe-Trp | Thr-Lys-Pro-Asn-Phe-Trp | Thr-Lys-Pro-Asn-Phe-Trp | 1818 |
| Thr-Lys-Pro-Asn-Tyr-Trp | Thr-Lys-Pro-Asn-Tyr-Trp | Thr-Lys-Pro-Asn-Tyr-Trp | 1819 |
| Thr-Lys-Pro-Asn-His-Trp | Thr-Lys-Pro-Asn-His-Trp | Thr-Lys-Pro-Asn-His-Trp | 1820 |
| Thr-Lys-Pro-Asn-Pro-Trp | Thr-Lys-Pro-Asn-Pro-Trp | Thr-Lys-Pro-Asn-Pro-Trp | 1821 |
| Thr-Lys-Pro-Asn-Lys-Trp | Thr-Lys-Pro-Asn-Lys-Trp | Thr-Lys-Pro-Asn-Lys-Trp | 1822 |
| Thr-Lys-Pro-Tyr-Trp | Thr-Lys-Pro-Tyr-Trp | Thr-Lys-Pro-Tyr-Trp | 1823 |
| Thr-Lys-Pro-Tyr-Arg-Trp | Thr-Lys-Pro-Tyr-Arg-Trp | Thr-Lys-Pro-Tyr-Arg-Trp | 1824 |
| Thr-Lys-Pro-Tyr-Phe-Trp | Thr-Lys-Pro-Tyr-Phe-Trp | Thr-Lys-Pro-Tyr-Phe-Trp | 1825 |
| Thr-Lys-Pro-Tyr-Tyr-Trp | Thr-Lys-Pro-Tyr-Tyr-Trp | Thr-Lys-Pro-Tyr-Tyr-Trp | 1826 |
| Thr-Lys-Pro-Tyr-His-Trp | Thr-Lys-Pro-Tyr-His-Trp | Thr-Lys-Pro-Tyr-His-Trp | 1827 |
| Thr-Lys-Pro-Tyr-Pro-Trp | Thr-Lys-Pro-Tyr-Pro-Trp | Thr-Lys-Pro-Tyr-Pro-Trp | 1828 |
| Thr-Lys-Pro-Tyr-Lys-Trp | Thr-Lys-Pro-Tyr-Lys-Trp | Thr-Lys-Pro-Tyr-Lys-Trp | 1829 |
| Thr-Lys-Pro-Arg-Trp | Thr-Lys-Pro-Arg-Trp | Thr-Lys-Pro-Arg-Trp | 1830 |
| Thr-Lys-Pro-Arg-Arg-Trp | Thr-Lys-Pro-Arg-Arg-Trp | Thr-Lys-Pro-Arg-Arg-Trp | 1831 |
| Thr-Lys-Pro-Arg-Phe-Trp | Thr-Lys-Pro-Arg-Phe-Trp | Thr-Lys-Pro-Arg-Phe-Trp | 1832 |
| Thr-Lys-Pro-Arg-Tyr-Trp | Thr-Lys-Pro-Arg-Tyr-Trp | Thr-Lys-Pro-Arg-Tyr-Trp | 1833 |
| Thr-Lys-Pro-Arg-His-Trp | Thr-Lys-Pro-Arg-His-Trp | Thr-Lys-Pro-Arg-His-Trp | 1834 |
| Thr-Lys-Pro-Arg-Pro-Trp | Thr-Lys-Pro-Arg-Pro-Trp | Thr-Lys-Pro-Arg-Pro-Trp | 1835 |
| Thr-Lys-Pro-Arg-Lys-Trp | Thr-Lys-Pro-Arg-Lys-Trp | Thr-Lys-Pro-Arg-Lys-Trp | 1836 |
| Met-Thr-Lys-Pro-Trp | Met-Thr-Lys-Pro-Trp | Met-Thr-Lys-Pro-Trp | 1837 |
| Met-Thr-Lys-Pro-Arg-Trp | Met-Thr-Lys-Pro-Arg-Trp | Met-Thr-Lys-Pro-Arg-Trp | 1838 |
| Met-Thr-Lys-Pro-Phe-Trp | Met-Thr-Lys-Pro-Phe-Trp | Met-Thr-Lys-Pro-Phe-Trp | 1839 |
| Met-Thr-Lys-Pro-Tyr-Trp | Met-Thr-Lys-Pro-Tyr-Trp | Met-Thr-Lys-Pro-Tyr-Trp | 1840 |
| Met-Thr-Lys-Pro-Gly-Trp | Met-Thr-Lys-Pro-Gly-Trp | Met-Thr-Lys-Pro-Gly-Trp | 1841 |
| Met-Thr-Lys-Pro-His-Trp | Met-Thr-Lys-Pro-His-Trp | Met-Thr-Lys-Pro-His-Trp | 1842 |
| Met-Thr-Lys-Pro-Lys-Trp | Met-Thr-Lys-Pro-Lys-Trp | Met-Thr-Lys-Pro-Lys-Trp | 1843 |
| Met-Thr-Lys-Pro-Gly-Trp | Met-Thr-Lys-Pro-Gly-Trp | Met-Thr-Lys-Pro-Gly-Trp | 1844 |
| Met-Thr-Lys-Pro-Gly-Arg-Trp | Met-Thr-Lys-Pro-Gly-Arg-Trp | Met-Thr-Lys-Pro-Gly-Arg-Trp | 1845 |
| Met-Thr-Lys-Pro-Gly-Phe-Trp | Met-Thr-Lys-Pro-Gly-Phe-Trp | Met-Thr-Lys-Pro-Gly-Phe-Trp | 1846 |

TABLE 1-continued

| X-OH | X-OCH₃ | X-NH₂ | SEQ ID NO |
|---|---|---|---|
| Met-Thr-Lys-Pro-Gly-Tyr-Trp | Met-Thr-Lys-Pro-Gly-Tyr-Trp | Met-Thr-Lys-Pro-Gly-Tyr-Trp | 1847 |
| Met-Thr-Lys-Pro-Gly-His-Trp | Met-Thr-Lys-Pro-Gly-His-Trp | Met-Thr-Lys-Pro-Gly-His-Trp | 1848 |
| Met-Thr-Lys-Pro-Gly-Pro-Trp | Met-Thr-Lys-Pro-Gly-Pro-Trp | Met-Thr-Lys-Pro-Gly-Pro-Trp | 1849 |
| Met-Thr-Lys-Pro-Gly-Lys-Trp | Met-Thr-Lys-Pro-Gly-Lys-Trp | Met-Thr-Lys-Pro-Gly-Lys-Trp | 1850 |
| Met-Thr-Lys-Pro-Asp-Trp | Met-Thr-Lys-Pro-Asp-Trp | Met-Thr-Lys-Pro-Asp-Trp | 1851 |
| Met-Thr-Lys-Pro-Asp-Arg-Trp | Met-Thr-Lys-Pro-Asp-Arg-Trp | Met-Thr-Lys-Pro-Asp-Arg-Trp | 1852 |
| Met-Thr-Lys-Pro-Asp-Phe-Trp | Met-Thr-Lys-Pro-Asp-Phe-Trp | Met-Thr-Lys-Pro-Asp-Phe-Trp | 1853 |
| Met-Thr-Lys-Pro-Asp-Tyr-Trp | Met-Thr-Lys-Pro-Asp-Tyr-Trp | Met-Thr-Lys-Pro-Asp-Tyr-Trp | 1854 |
| Met-Thr-Lys-Pro-Asp-His-Trp | Met-Thr-Lys-Pro-Asp-His-Trp | Met-Thr-Lys-Pro-Asp-His-Trp | 1855 |
| Met-Thr-Lys-Pro-Asp-Pro-Trp | Met-Thr-Lys-Pro-Asp-Pro-Trp | Met-Thr-Lys-Pro-Asp-Pro-Trp | 1856 |
| Met-Thr-Lys-Pro-Asp-Lys-Trp | Met-Thr-Lys-Pro-Asp-Lys-Trp | Met-Thr-Lys-Pro-Asp-Lys-Trp | 1857 |
| Met-Thr-Lys-Pro-Trp-Trp | Met-Thr-Lys-Pro-Trp-Trp | Met-Thr-Lys-Pro-Trp-Trp | 1858 |
| Met-Thr-Lys-Pro-Trp-Arg-Trp | Met-Thr-Lys-Pro-Trp-Arg-Trp | Met-Thr-Lys-Pro-Trp-Arg-Trp | 1859 |
| Met-Thr-Lys-Pro-Trp-Phe-Trp | Met-Thr-Lys-Pro-Trp-Phe-Trp | Met-Thr-Lys-Pro-Trp-Phe-Trp | 1860 |
| Met-Thr-Lys-Pro-Trp-Tyr-Trp | Met-Thr-Lys-Pro-Trp-Tyr-Trp | Met-Thr-Lys-Pro-Trp-Tyr-Trp | 1861 |
| Met-Thr-Lys-Pro-Trp-His-Trp | Met-Thr-Lys-Pro-Trp-His-Trp | Met-Thr-Lys-Pro-Trp-His-Trp | 1862 |
| Met-Thr-Lys-Pro-Trp-Pro-Trp | Met-Thr-Lys-Pro-Trp-Pro-Trp | Met-Thr-Lys-Pro-Trp-Pro-Trp | 1863 |
| Met-Thr-Lys-Pro-Trp-Lys-Trp | Met-Thr-Lys-Pro-Trp-Lys-Trp | Met-Thr-Lys-Pro-Trp-Lys-Trp | 1864 |
| Met-Thr-Lys-Pro-Gln-Trp | Met-Thr-Lys-Pro-Gln-Trp | Met-Thr-Lys-Pro-Gln-Trp | 1865 |
| Met-Thr-Lys-Pro-Gln-Arg-Trp | Met-Thr-Lys-Pro-Gln-Arg-Trp | Met-Thr-Lys-Pro-Gln-Arg-Trp | 1866 |
| Met-Thr-Lys-Pro-Gln-Phe-Trp | Met-Thr-Lys-Pro-Gln-Phe-Trp | Met-Thr-Lys-Pro-Gln-Phe-Trp | 1867 |
| Met-Thr-Lys-Pro-Gln-Tyr-Trp | Met-Thr-Lys-Pro-Gln-Tyr-Trp | Met-Thr-Lys-Pro-Gln-Tyr-Trp | 1868 |
| Met-Thr-Lys-Pro-Gln-His-Trp | Met-Thr-Lys-Pro-Gln-His-Trp | Met-Thr-Lys-Pro-Gln-His-Trp | 1869 |
| Met-Thr-Lys-Pro-Gln-Pro-Trp | Met-Thr-Lys-Pro-Gln-Pro-Trp | Met-Thr-Lys-Pro-Gln-Pro-Trp | 1870 |
| Met-Thr-Lys-Pro-Gln-Lys-Trp | Met-Thr-Lys-Pro-Gln-Lys-Trp | Met-Thr-Lys-Pro-Gln-Lys-Trp | 1871 |
| Met-Thr-Lys-Pro-Asn-Trp | Met-Thr-Lys-Pro-Asn-Trp | Met-Thr-Lys-Pro-Asn-Trp | 1872 |
| Met-Thr-Lys-Pro-Asn-Arg-Trp | Met-Thr-Lys-Pro-Asn-Arg-Trp | Met-Thr-Lys-Pro-Asn-Arg-Trp | 1873 |
| Met-Thr-Lys-Pro-Asn-Phe-Trp | Met-Thr-Lys-Pro-Asn-Phe-Trp | Met-Thr-Lys-Pro-Asn-Phe-Trp | 1874 |
| Met-Thr-Lys-Pro-Asn-Tyr-Trp | Met-Thr-Lys-Pro-Asn-Tyr-Trp | Met-Thr-Lys-Pro-Asn-Tyr-Trp | 1875 |
| Met-Thr-Lys-Pro-Asn-His-Trp | Met-Thr-Lys-Pro-Asn-His-Trp | Met-Thr-Lys-Pro-Asn-His-Trp | 1876 |
| Met-Thr-Lys-Pro-Asn-Pro-Trp | Met-Thr-Lys-Pro-Asn-Pro-Trp | Met-Thr-Lys-Pro-Asn-Pro-Trp | 1877 |
| Met-Thr-Lys-Pro-Asn-Lys-Trp | Met-Thr-Lys-Pro-Asn-Lys-Trp | Met-Thr-Lys-Pro-Asn-Lys-Trp | 1878 |
| Met-Thr-Lys-Pro-Tyr-Trp | Met-Thr-Lys-Pro-Tyr-Trp | Met-Thr-Lys-Pro-Tyr-Trp | 1879 |
| Met-Thr-Lys-Pro-Tyr-Arg-Trp | Met-Thr-Lys-Pro-Tyr-Arg-Trp | Met-Thr-Lys-Pro-Tyr-Arg-Trp | 1880 |
| Met-Thr-Lys-Pro-Tyr-Phe-Trp | Met-Thr-Lys-Pro-Tyr-Phe-Trp | Met-Thr-Lys-Pro-Tyr-Phe-Trp | 1881 |
| Met-Thr-Lys-Pro-Tyr-Tyr-Trp | Met-Thr-Lys-Pro-Tyr-Tyr-Trp | Met-Thr-Lys-Pro-Tyr-Tyr-Trp | 1882 |
| Met-Thr-Lys-Pro-Tyr-His-Trp | Met-Thr-Lys-Pro-Tyr-His-Trp | Met-Thr-Lys-Pro-Tyr-His-Trp | 1883 |
| Met-Thr-Lys-Pro-Tyr-Pro-Trp | Met-Thr-Lys-Pro-Tyr-Pro-Trp | Met-Thr-Lys-Pro-Tyr-Pro-Trp | 1884 |

TABLE 1-continued

| X-OH | X-OCH₃ | X-NH₂ | SEQ ID NO |
|---|---|---|---|
| Met-Thr-Lys-Pro-Tyr-Lys-Trp | Met-Thr-Lys-Pro-Tyr-Lys-Trp | Met-Thr-Lys-Pro-Tyr-Lys-Trp | 1885 |
| Met-Thr-Lys-Pro-Arg-Trp | Met-Thr-Lys-Pro-Arg-Trp | Met-Thr-Lys-Pro-Arg-Trp | 1886 |
| Met-Thr-Lys-Pro-Arg-Arg-Trp | Met-Thr-Lys-Pro-Arg-Arg-Trp | Met-Thr-Lys-Pro-Arg-Arg-Trp | 1887 |
| Met-Thr-Lys-Pro-Arg-Phe-Trp | Met-Thr-Lys-Pro-Arg-Phe-Trp | Met-Thr-Lys-Pro-Arg-Phe-Trp | 1888 |
| Met-Thr-Lys-Pro-Arg-Tyr-Trp | Met-Thr-Lys-Pro-Arg-Tyr-Trp | Met-Thr-Lys-Pro-Arg-Tyr-Trp | 1889 |
| Met-Thr-Lys-Pro-Arg-His-Trp | Met-Thr-Lys-Pro-Arg-His-Trp | Met-Thr-Lys-Pro-Arg-His-Trp | 1890 |
| Met-Thr-Lys-Pro-Arg-Pro-Trp | Met-Thr-Lys-Pro-Arg-Pro-Trp | Met-Thr-Lys-Pro-Arg-Pro-Trp | 1891 |
| Met-Thr-Lys-Pro-Arg-Lys-Trp | Met-Thr-Lys-Pro-Arg-Lys-Trp | Met-Thr-Lys-Pro-Arg-Lys-Trp | 1892 |
| Met(O)-Thr-Lys-Pro-Trp | Met(O)-Thr-Lys-Pro-Trp | Met(O)-Thr-Lys-Pro-Trp | 1893 |
| Met(O)-Thr-Lys-Pro-Arg-Trp | Met(O)-Thr-Lys-Pro-Arg-Trp | Met(O)-Thr-Lys-Pro-Arg-Trp | 1894 |
| Met(O)-Thr-Lys-Pro-Phe-Trp | Met(O)-Thr-Lys-Pro-Phe-Trp | Met(O)-Thr-Lys-Pro-Phe-Trp | 1895 |
| Met(O)-Thr-Lys-Pro-Tyr-Trp | Met(O)-Thr-Lys-Pro-Tyr-Trp | Met(O)-Thr-Lys-Pro-Tyr-Trp | 1896 |
| Met(O)-Thr-Lys-Pro-Gly-Trp | Met(O)-Thr-Lys-Pro-Gly-Trp | Met(O)-Thr-Lys-Pro-Gly-Trp | 1897 |
| Met(O)-Thr-Lys-Pro-His-Trp | Met(O)-Thr-Lys-Pro-His-Trp | Met(O)-Thr-Lys-Pro-His-Trp | 1898 |
| Met(O)-Thr-Lys-Pro-Lys-Trp | Met(O)-Thr-Lys-Pro-Lys-Trp | Met(O)-Thr-Lys-Pro-Lys-Trp | 1899 |
| Met(O)-Thr-Lys-Pro-Gly-Trp | Met(O)-Thr-Lys-Pro-Gly-Trp | Met(O)-Thr-Lys-Pro-Gly-Trp | 1900 |
| Met(O)-Thr-Lys-Pro-Gly-Arg-Trp | Met(O)-Thr-Lys-Pro-Gly-Arg-Trp | Met(O)-Thr-Lys-Pro-Gly-Arg-Trp | 1901 |
| Met(O)-Thr-Lys-Pro-Gly-Phe-Trp | Met(O)-Thr-Lys-Pro-Gly-Phe-Trp | Met(O)-Thr-Lys-Pro-Gly-Phe-Trp | 1902 |
| Met(O)-Thr-Lys-Pro-Gly-Tyr-Trp | Met(O)-Thr-Lys-Pro-Gly-Tyr-Trp | Met(O)-Thr-Lys-Pro-Gly-Tyr-Trp | 1903 |
| Met(O)-Thr-Lys-Pro-Gly-His-Trp | Met(O)-Thr-Lys-Pro-Gly-His-Trp | Met(O)-Thr-Lys-Pro-Gly-His-Trp | 1904 |
| Met(O)-Thr-Lys-Pro-Gly-Pro-Trp | Met(O)-Thr-Lys-Pro-Gly-Pro-Trp | Met(O)-Thr-Lys-Pro-Gly-Pro-Trp | 1905 |
| Met(O)-Thr-Lys-Pro-Gly-Lys-Trp | Met(O)-Thr-Lys-Pro-Gly-Lys-Trp | Met(O)-Thr-Lys-Pro-Gly-Lys-Trp | 1906 |
| Met(O)-Thr-Lys-Pro-Asp-Trp | Met(O)-Thr-Lys-Pro-Asp-Trp | Met(O)-Thr-Lys-Pro-Asp-Trp | 1907 |
| Met(O)-Thr-Lys-Pro-Asp-Arg-Trp | Met(O)-Thr-Lys-Pro-Asp-Arg-Trp | Met(O)-Thr-Lys-Pro-Asp-Arg-Trp | 1908 |
| Met(O)-Thr-Lys-Pro-Asp-Phe-Trp | Met(O)-Thr-Lys-Pro-Asp-Phe-Trp | Met(O)-Thr-Lys-Pro-Asp-Phe-Trp | 1909 |
| Met(O)-Thr-Lys-Pro-Asp-Tyr-Trp | Met(O)-Thr-Lys-Pro-Asp-Tyr-Trp | Met(O)-Thr-Lys-Pro-Asp-Tyr-Trp | 1910 |
| Met(O)-Thr-Lys-Pro-Asp-His-Trp | Met(O)-Thr-Lys-Pro-Asp-His-Trp | Met(O)-Thr-Lys-Pro-Asp-His-Trp | 1911 |
| Met(O)-Thr-Lys-Pro-Asp-Pro-Trp | Met(O)-Thr-Lys-Pro-Asp-Pro-Trp | Met(O)-Thr-Lys-Pro-Asp-Pro-Trp | 1912 |
| Met(O)-Thr-Lys-Pro-Asp-Lys-Trp | Met(O)-Thr-Lys-Pro-Asp-Lys-Trp | Met(O)-Thr-Lys-Pro-Asp-Lys-Trp | 1913 |
| Met(O)-Thr-Lys-Pro-Trp-Trp | Met(O)-Thr-Lys-Pro-Trp-Trp | Met(O)-Thr-Lys-Pro-Trp-Trp | 1914 |
| Met(O)-Thr-Lys-Pro-Trp-Arg-Trp | Met(O)-Thr-Lys-Pro-Trp-Arg-Trp | Met(O)-Thr-Lys-Pro-Trp-Arg-Trp | 1915 |

TABLE 1-continued

| X-OH | X-OCH₃ | X-NH₂ | SEQ ID NO |
|---|---|---|---|
| Met(O)-Thr-Lys-Pro-Trp-Phe-Trp | Met(O)-Thr-Lys-Pro-Trp-Phe-Trp | Met(O)-Thr-Lys-Pro-Trp-Phe-Trp | 1916 |
| Met(O)-Thr-Lys-Pro-Trp-Tyr-Trp | Met(O)-Thr-Lys-Pro-Trp-Tyr-Trp | Met(O)-Thr-Lys-Pro-Trp-Tyr-Trp | 1917 |
| Met(O)-Thr-Lys-Pro-Trp-His-Trp | Met(O)-Thr-Lys-Pro-Trp-His-Trp | Met(O)-Thr-Lys-Pro-Trp-His-Trp | 1918 |
| Met(O)-Thr-Lys-Pro-Trp-Pro-Trp | Met(O)-Thr-Lys-Pro-Trp-Pro-Trp | Met(O)-Thr-Lys-Pro-Trp-Pro-Trp | 1919 |
| Met(O)-Thr-Lys-Pro-Trp-Lys-Trp | Met(O)-Thr-Lys-Pro-Trp-Lys-Trp | Met(O)-Thr-Lys-Pro-Trp-Lys-Trp | 1920 |
| Met(O)-Thr-Lys-Pro-Gln-Trp | Met(O)-Thr-Lys-Pro-Gln-Trp | Met(O)-Thr-Lys-Pro-Gln-Trp | 1921 |
| Met(O)-Thr-Lys-Pro-Gln-Arg-Trp | Met(O)-Thr-Lys-Pro-Gln-Arg-Trp | Met(O)-Thr-Lys-Pro-Gln-Arg-Trp | 1922 |
| Met(O)-Thr-Lys-Pro-Gln-Phe-Trp | Met(O)-Thr-Lys-Pro-Gln-Phe-Trp | Met(O)-Thr-Lys-Pro-Gln-Phe-Trp | 1923 |
| Met(O)-Thr-Lys-Pro-Gln-Tyr-Trp | Met(O)-Thr-Lys-Pro-Gln-Tyr-Trp | Met(O)-Thr-Lys-Pro-Gln-Tyr-Trp | 1924 |
| Met(O)-Thr-Lys-Pro-Gln-His-Trp | Met(O)-Thr-Lys-Pro-Gln-His-Trp | Met(O)-Thr-Lys-Pro-Gln-His-Trp | 1925 |
| Met(O)-Thr-Lys-Pro-Gln-Pro-Trp | Met(O)-Thr-Lys-Pro-Gln-Pro-Trp | Met(O)-Thr-Lys-Pro-Gln-Pro-Trp | 1926 |
| Met(O)-Thr-Lys-Pro-Gln-Lys-Trp | Met(O)-Thr-Lys-Pro-Gln-Lys-Trp | Met(O)-Thr-Lys-Pro-Gln-Lys-Trp | 1927 |
| Met(O)-Thr-Lys-Pro-Asn-Trp | Met(O)-Thr-Lys-Pro-Asn-Trp | Met(O)-Thr-Lys-Pro-Asn-Trp | 1928 |
| Met(O)-Thr-Lys-Pro-Asn-Arg-Trp | Met(O)-Thr-Lys-Pro-Asn-Arg-Trp | Met(O)-Thr-Lys-Pro-Asn-Arg-Trp | 1929 |
| Met(O)-Thr-Lys-Pro-Asn-Phe-Trp | Met(O)-Thr-Lys-Pro-Asn-Phe-Trp | Met(O)-Thr-Lys-Pro-Asn-Phe-Trp | 1930 |
| Met(O)-Thr-Lys-Pro-Asn-Tyr-Trp | Met(O)-Thr-Lys-Pro-Asn-Tyr-Trp | Met(O)-Thr-Lys-Pro-Asn-Tyr-Trp | 1931 |
| Met(O)-Thr-Lys-Pro-Asn-His-Trp | Met(O)-Thr-Lys-Pro-Asn-His-Trp | Met(O)-Thr-Lys-Pro-Asn-His-Trp | 1932 |
| Met(O)-Thr-Lys-Pro-Asn-Pro-Trp | Met(O)-Thr-Lys-Pro-Asn-Pro-Trp | Met(O)-Thr-Lys-Pro-Asn-Pro-Trp | 1933 |
| Met(O)-Thr-Lys-Pro-Asn-Lys-Trp | Met(O)-Thr-Lys-Pro-Asn-Lys-Trp | Met(O)-Thr-Lys-Pro-Asn-Lys-Trp | 1934 |
| Met(O)-Thr-Lys-Pro-Tyr-Trp | Met(O)-Thr-Lys-Pro-Tyr-Trp | Met(O)-Thr-Lys-Pro-Tyr-Trp | 1935 |
| Met(O)-Thr-Lys-Pro-Tyr-Arg-Trp | Met(O)-Thr-Lys-Pro-Tyr-Arg-Trp | Met(O)-Thr-Lys-Pro-Tyr-Arg-Trp | 1936 |
| Met(O)-Thr-Lys-Pro-Tyr-Phe-Trp | Met(O)-Thr-Lys-Pro-Tyr-Phe-Trp | Met(O)-Thr-Lys-Pro-Tyr-Phe-Trp | 1937 |
| Met(O)-Thr-Lys-Pro-Tyr-Tyr-Trp | Met(O)-Thr-Lys-Pro-Tyr-Tyr-Trp | Met(O)-Thr-Lys-Pro-Tyr-Tyr-Trp | 1938 |
| Met(O)-Thr-Lys-Pro-Tyr-His-Trp | Met(O)-Thr-Lys-Pro-Tyr-His-Trp | Met(O)-Thr-Lys-Pro-Tyr-His-Trp | 1939 |
| Met(O)-Thr-Lys-Pro-Tyr-Pro-Trp | Met(O)-Thr-Lys-Pro-Tyr-Pro-Trp | Met(O)-Thr-Lys-Pro-Tyr-Pro-Trp | 1940 |
| Met(O)-Thr-Lys-Pro-Tyr-Lys-Trp | Met(O)-Thr-Lys-Pro-Tyr-Lys-Trp | Met(O)-Thr-Lys-Pro-Tyr-Lys-Trp | 1941 |
| Met(O)-Thr-Lys-Pro-Arg-Trp | Met(O)-Thr-Lys-Pro-Arg-Trp | Met(O)-Thr-Lys-Pro-Arg-Trp | 1942 |

TABLE 1-continued

| X-OH | X-OCH₃ | X-NH₂ | SEQ ID NO |
|---|---|---|---|
| Met(O)-Thr-Lys-Pro-Arg-Arg-Trp | Met(O)-Thr-Lys-Pro-Arg-Arg-Trp | Met(O)-Thr-Lys-Pro-Arg-Arg-Trp | 1943 |
| Met(O)-Thr-Lys-Pro-Arg-Phe-Trp | Met(O)-Thr-Lys-Pro-Arg-Phe-Trp | Met(O)-Thr-Lys-Pro-Arg-Phe-Trp | 1944 |
| Met(O)-Thr-Lys-Pro-Arg-Tyr-Trp | Met(O)-Thr-Lys-Pro-Arg-Tyr-Trp | Met(O)-Thr-Lys-Pro-Arg-Tyr-Trp | 1945 |
| Met(O)-Thr-Lys-Pro-Arg-His-Trp | Met(O)-Thr-Lys-Pro-Arg-His-Trp | Met(O)-Thr-Lys-Pro-Arg-His-Trp | 1946 |
| Met(O)-Thr-Lys-Pro-Arg-Pro-Trp | Met(O)-Thr-Lys-Pro-Arg-Pro-Trp | Met(O)-Thr-Lys-Pro-Arg-Pro-Trp | 1947 |
| Met(O)-Thr-Lys-Pro-Arg-Lys-Trp | Met(O)-Thr-Lys-Pro-Arg-Lys-Trp | Met(O)-Thr-Lys-Pro-Arg-Lys-Trp | 1948 |
| Thr-Thr-Lys-Pro-Trp | Thr-Thr-Lys-Pro-Trp | Thr-Thr-Lys-Pro-Trp | 1949 |
| Thr-Thr-Lys-Pro-Arg-Trp | Thr-Thr-Lys-Pro-Arg-Trp | Thr-Thr-Lys-Pro-Arg-Trp | 1950 |
| Thr-Thr-Lys-Pro-Phe-Trp | Thr-Thr-Lys-Pro-Phe-Trp | Thr-Thr-Lys-Pro-Phe-Trp | 1951 |
| Thr-Thr-Lys-Pro-Tyr-Trp | Thr-Thr-Lys-Pro-Tyr-Trp | Thr-Thr-Lys-Pro-Tyr-Trp | 1952 |
| Thr-Thr-Lys-Pro-Gly-Trp | Thr-Thr-Lys-Pro-Gly-Trp | Thr-Thr-Lys-Pro-Gly-Trp | 1953 |
| Thr-Thr-Lys-Pro-His-Trp | Thr-Thr-Lys-Pro-His-Trp | Thr-Thr-Lys-Pro-His-Trp | 1954 |
| Thr-Thr-Lys-Pro-Lys-Trp | Thr-Thr-Lys-Pro-Lys-Trp | Thr-Thr-Lys-Pro-Lys-Trp | 1955 |
| Thr-Thr-Lys-Pro-Gly-Trp | Thr-Thr-Lys-Pro-Gly-Trp | Thr-Thr-Lys-Pro-Gly-Trp | 1956 |
| Thr-Thr-Lys-Pro-Gly-Arg-Trp | Thr-Thr-Lys-Pro-Gly-Arg-Trp | Thr-Thr-Lys-Pro-Gly-Arg-Trp | 1957 |
| Thr-Thr-Lys-Pro-Gly-Phe-Trp | Thr-Thr-Lys-Pro-Gly-Phe-Trp | Thr-Thr-Lys-Pro-Gly-Phe-Trp | 1958 |
| Thr-Thr-Lys-Pro-Gly-Tyr-Trp | Thr-Thr-Lys-Pro-Gly-Tyr-Trp | Thr-Thr-Lys-Pro-Gly-Tyr-Trp | 1959 |
| Thr-Thr-Lys-Pro-Gly-His-Trp | Thr-Thr-Lys-Pro-Gly-His-Trp | Thr-Thr-Lys-Pro-Gly-His-Trp | 1960 |
| Thr-Thr-Lys-Pro-Gly-Pro-Trp | Thr-Thr-Lys-Pro-Gly-Pro-Trp | Thr-Thr-Lys-Pro-Gly-Pro-Trp | 1961 |
| Thr-Thr-Lys-Pro-Gly-Lys-Trp | Thr-Thr-Lys-Pro-Gly-Lys-Trp | Thr-Thr-Lys-Pro-Gly-Lys-Trp | 1962 |
| Thr-Thr-Lys-Pro-Asp-Trp | Thr-Thr-Lys-Pro-Asp-Trp | Thr-Thr-Lys-Pro-Asp-Trp | 1963 |
| Thr-Thr-Lys-Pro-Asp-Arg-Trp | Thr-Thr-Lys-Pro-Asp-Arg-Trp | Thr-Thr-Lys-Pro-Asp-Arg-Trp | 1964 |
| Thr-Thr-Lys-Pro-Asp-Phe-Trp | Thr-Thr-Lys-Pro-Asp-Phe-Trp | Thr-Thr-Lys-Pro-Asp-Phe-Trp | 1965 |
| Thr-Thr-Lys-Pro-Asp-Tyr-Trp | Thr-Thr-Lys-Pro-Asp-Tyr-Trp | Thr-Thr-Lys-Pro-Asp-Tyr-Trp | 1966 |
| Thr-Thr-Lys-Pro-Asp-His-Trp | Thr-Thr-Lys-Pro-Asp-His-Trp | Thr-Thr-Lys-Pro-Asp-His-Trp | 1967 |
| Thr-Thr-Lys-Pro-Asp-Pro-Trp | Thr-Thr-Lys-Pro-Asp-Pro-Trp | Thr-Thr-Lys-Pro-Asp-Pro-Trp | 1968 |
| Thr-Thr-Lys-Pro-Asp-Lys-Trp | Thr-Thr-Lys-Pro-Asp-Lys-Trp | Thr-Thr-Lys-Pro-Asp-Lys-Trp | 1969 |
| Thr-Thr-Lys-Pro-Trp-Trp | Thr-Thr-Lys-Pro-Trp-Trp | Thr-Thr-Lys-Pro-Trp-Trp | 1970 |
| Thr-Thr-Lys-Pro-Trp-Arg-Trp | Thr-Thr-Lys-Pro-Trp-Arg-Trp | Thr-Thr-Lys-Pro-Trp-Arg-Trp | 1971 |
| Thr-Thr-Lys-Pro-Trp-Phe-Trp | Thr-Thr-Lys-Pro-Trp-Phe-Trp | Thr-Thr-Lys-Pro-Trp-Phe-Trp | 1972 |
| Thr-Thr-Lys-Pro-Trp-Tyr-Trp | Thr-Thr-Lys-Pro-Trp-Tyr-Trp | Thr-Thr-Lys-Pro-Trp-Tyr-Trp | 1973 |
| Thr-Thr-Lys-Pro-Trp-His-Trp | Thr-Thr-Lys-Pro-Trp-His-Trp | Thr-Thr-Lys-Pro-Trp-His-Trp | 1974 |
| Thr-Thr-Lys-Pro-Trp-Pro-Trp | Thr-Thr-Lys-Pro-Trp-Pro-Trp | Thr-Thr-Lys-Pro-Trp-Pro-Trp | 1975 |
| Thr-Thr-Lys-Pro-Trp-Lys-Trp | Thr-Thr-Lys-Pro-Trp-Lys-Trp | Thr-Thr-Lys-Pro-Trp-Lys-Trp | 1976 |
| Thr-Thr-Lys-Pro-Gln-Trp | Thr-Thr-Lys-Pro-Gln-Trp | Thr-Thr-Lys-Pro-Gln-Trp | 1977 |

TABLE 1-continued

| X-OH | X-OCH₃ | X-NH₂ | SEQ ID NO |
|---|---|---|---|
| Thr-Thr-Lys-Pro-Gln-Arg-Trp | Thr-Thr-Lys-Pro-Gln-Arg-Trp | Thr-Thr-Lys-Pro-Gln-Arg-Trp | 1978 |
| Thr-Thr-Lys-Pro-Gln-Phe-Trp | Thr-Thr-Lys-Pro-Gln-Phe-Trp | Thr-Thr-Lys-Pro-Gln-Phe-Trp | 1979 |
| Thr-Thr-Lys-Pro-Gln-Tyr-Trp | Thr-Thr-Lys-Pro-Gln-Tyr-Trp | Thr-Thr-Lys-Pro-Gln-Tyr-Trp | 1980 |
| Thr-Thr-Lys-Pro-Gln-His-Trp | Thr-Thr-Lys-Pro-Gln-His-Trp | Thr-Thr-Lys-Pro-Gln-His-Trp | 1981 |
| Thr-Thr-Lys-Pro-Gln-Pro-Trp | Thr-Thr-Lys-Pro-Gln-Pro-Trp | Thr-Thr-Lys-Pro-Gln-Pro-Trp | 1982 |
| Thr-Thr-Lys-Pro-Gln-Lys-Trp | Thr-Thr-Lys-Pro-Gln-Lys-Trp | Thr-Thr-Lys-Pro-Gln-Lys-Trp | 1983 |
| Thr-Thr-Lys-Pro-Asn-Trp | Thr-Thr-Lys-Pro-Asn-Trp | Thr-Thr-Lys-Pro-Asn-Trp | 1984 |
| Thr-Thr-Lys-Pro-Asn-Arg-Trp | Thr-Thr-Lys-Pro-Asn-Arg-Trp | Thr-Thr-Lys-Pro-Asn-Arg-Trp | 1985 |
| Thr-Thr-Lys-Pro-Asn-Phe-Trp | Thr-Thr-Lys-Pro-Asn-Phe-Trp | Thr-Thr-Lys-Pro-Asn-Phe-Trp | 1986 |
| Thr-Thr-Lys-Pro-Asn-Tyr-Trp | Thr-Thr-Lys-Pro-Asn-Tyr-Trp | Thr-Thr-Lys-Pro-Asn-Tyr-Trp | 1987 |
| Thr-Thr-Lys-Pro-Asn-His-Trp | Thr-Thr-Lys-Pro-Asn-His-Trp | Thr-Thr-Lys-Pro-Asn-His-Trp | 1988 |
| Thr-Thr-Lys-Pro-Asn-Pro-Trp | Thr-Thr-Lys-Pro-Asn-Pro-Trp | Thr-Thr-Lys-Pro-Asn-Pro-Trp | 1989 |
| Thr-Thr-Lys-Pro-Asn-Lys-Trp | Thr-Thr-Lys-Pro-Asn-Lys-Trp | Thr-Thr-Lys-Pro-Asn-Lys-Trp | 1990 |
| Thr-Thr-Lys-Pro-Tyr-Trp | Thr-Thr-Lys-Pro-Tyr-Trp | Thr-Thr-Lys-Pro-Tyr-Trp | 1991 |
| Thr-Thr-Lys-Pro-Tyr-Arg-Trp | Thr-Thr-Lys-Pro-Tyr-Arg-Trp | Thr-Thr-Lys-Pro-Tyr-Arg-Trp | 1992 |
| Thr-Thr-Lys-Pro-Tyr-Phe-Trp | Thr-Thr-Lys-Pro-Tyr-Phe-Trp | Thr-Thr-Lys-Pro-Tyr-Phe-Trp | 1993 |
| Thr-Thr-Lys-Pro-Tyr-Tyr-Trp | Thr-Thr-Lys-Pro-Tyr-Tyr-Trp | Thr-Thr-Lys-Pro-Tyr-Tyr-Trp | 1994 |
| Thr-Thr-Lys-Pro-Tyr-His-Trp | Thr-Thr-Lys-Pro-Tyr-His-Trp | Thr-Thr-Lys-Pro-Tyr-His-Trp | 1995 |
| Thr-Thr-Lys-Pro-Tyr-Pro-Trp | Thr-Thr-Lys-Pro-Tyr-Pro-Trp | Thr-Thr-Lys-Pro-Tyr-Pro-Trp | 1996 |
| Thr-Thr-Lys-Pro-Tyr-Lys-Trp | Thr-Thr-Lys-Pro-Tyr-Lys-Trp | Thr-Thr-Lys-Pro-Tyr-Lys-Trp | 1997 |
| Thr-Thr-Lys-Pro-Arg-Trp | Thr-Thr-Lys-Pro-Arg-Trp | Thr-Thr-Lys-Pro-Arg-Trp | 1998 |
| Thr-Thr-Lys-Pro-Arg-Arg-Trp | Thr-Thr-Lys-Pro-Arg-Arg-Trp | Thr-Thr-Lys-Pro-Arg-Arg-Trp | 1999 |
| Thr-Thr-Lys-Pro-Arg-Phe-Trp | Thr-Thr-Lys-Pro-Arg-Phe-Trp | Thr-Thr-Lys-Pro-Arg-Phe-Trp | 2000 |
| Thr-Thr-Lys-Pro-Arg-Tyr-Trp | Thr-Thr-Lys-Pro-Arg-Tyr-Trp | Thr-Thr-Lys-Pro-Arg-Tyr-Trp | 2001 |
| Thr-Thr-Lys-Pro-Arg-His-Trp | Thr-Thr-Lys-Pro-Arg-His-Trp | Thr-Thr-Lys-Pro-Arg-His-Trp | 2002 |
| Thr-Thr-Lys-Pro-Arg-Pro-Trp | Thr-Thr-Lys-Pro-Arg-Pro-Trp | Thr-Thr-Lys-Pro-Arg-Pro-Trp | 2003 |
| Thr-Thr-Lys-Pro-Arg-Lys-Trp | Thr-Thr-Lys-Pro-Arg-Lys-Trp | Thr-Thr-Lys-Pro-Arg-Lys-Trp | 2004 |
| Ala-Thr-Lys-Pro-Trp | Ala-Thr-Lys-Pro-Trp | Ala-Thr-Lys-Pro-Trp | 2005 |
| Ala-Thr-Lys-Pro-Arg-Trp | Ala-Thr-Lys-Pro-Arg-Trp | Ala-Thr-Lys-Pro-Arg-Trp | 2006 |
| Ala-Thr-Lys-Pro-Phe-Trp | Ala-Thr-Lys-Pro-Phe-Trp | Ala-Thr-Lys-Pro-Phe-Trp | 2007 |
| Ala-Thr-Lys-Pro-Tyr-Trp | Ala-Thr-Lys-Pro-Tyr-Trp | Ala-Thr-Lys-Pro-Tyr-Trp | 2008 |
| Ala-Thr-Lys-Pro-Gly-Trp | Ala-Thr-Lys-Pro-Gly-Trp | Ala-Thr-Lys-Pro-Gly-Trp | 2009 |
| Ala-Thr-Lys-Pro-His-Trp | Ala-Thr-Lys-Pro-His-Trp | Ala-Thr-Lys-Pro-His-Trp | 2010 |
| Ala-Thr-Lys-Pro-Lys-Trp | Ala-Thr-Lys-Pro-Lys-Trp | Ala-Thr-Lys-Pro-Lys-Trp | 2011 |
| Ala-Thr-Lys-Pro-Gly-Trp | Ala-Thr-Lys-Pro-Gly-Trp | Ala-Thr-Lys-Pro-Gly-Trp | 2012 |
| Ala-Thr-Lys-Pro-Gly-Arg-Trp | Ala-Thr-Lys-Pro-Gly-Arg-Trp | Ala-Thr-Lys-Pro-Gly-Arg-Trp | 2013 |
| Ala-Thr-Lys-Pro-Gly-Phe-Trp | Ala-Thr-Lys-Pro-Gly-Phe-Trp | Ala-Thr-Lys-Pro-Gly-Phe-Trp | 2014 |
| Ala-Thr-Lys-Pro-Gly-Tyr-Trp | Ala-Thr-Lys-Pro-Gly-Tyr-Trp | Ala-Thr-Lys-Pro-Gly-Tyr-Trp | 2015 |

TABLE 1-continued

| X-OH | X-OCH₃ | X-NH₂ | SEQ ID NO |
|---|---|---|---|
| Ala-Thr-Lys-Pro-Gly-His-Trp | Ala-Thr-Lys-Pro-Gly-His-Trp | Ala-Thr-Lys-Pro-Gly-His-Trp | 2016 |
| Ala-Thr-Lys-Pro-Gly-Pro-Trp | Ala-Thr-Lys-Pro-Gly-Pro-Trp | Ala-Thr-Lys-Pro-Gly-Pro-Trp | 2017 |
| Ala-Thr-Lys-Pro-Gly-Lys-Trp | Ala-Thr-Lys-Pro-Gly-Lys-Trp | Ala-Thr-Lys-Pro-Gly-Lys-Trp | 2018 |
| Ala-Thr-Lys-Pro-Asp-Trp | Ala-Thr-Lys-Pro-Asp-Trp | Ala-Thr-Lys-Pro-Asp-Trp | 2019 |
| Ala-Thr-Lys-Pro-Asp-Arg-Trp | Ala-Thr-Lys-Pro-Asp-Arg-Trp | Ala-Thr-Lys-Pro-Asp-Arg-Trp | 2020 |
| Ala-Thr-Lys-Pro-Asp-Phe-Trp | Ala-Thr-Lys-Pro-Asp-Phe-Trp | Ala-Thr-Lys-Pro-Asp-Phe-Trp | 2021 |
| Ala-Thr-Lys-Pro-Asp-Tyr-Trp | Ala-Thr-Lys-Pro-Asp-Tyr-Trp | Ala-Thr-Lys-Pro-Asp-Tyr-Trp | 2022 |
| Ala-Thr-Lys-Pro-Asp-His-Trp | Ala-Thr-Lys-Pro-Asp-His-Trp | Ala-Thr-Lys-Pro-Asp-His-Trp | 2023 |
| Ala-Thr-Lys-Pro-Asp-Pro-Trp | Ala-Thr-Lys-Pro-Asp-Pro-Trp | Ala-Thr-Lys-Pro-Asp-Pro-Trp | 2024 |
| Ala-Thr-Lys-Pro-Asp-Lys-Trp | Ala-Thr-Lys-Pro-Asp-Lys-Trp | Ala-Thr-Lys-Pro-Asp-Lys-Trp | 2025 |
| Ala-Thr-Lys-Pro-Trp-Trp | Ala-Thr-Lys-Pro-Trp-Trp | Ala-Thr-Lys-Pro-Trp-Trp | 2026 |
| Ala-Thr-Lys-Pro-Trp-Arg-Trp | Ala-Thr-Lys-Pro-Trp-Arg-Trp | Ala-Thr-Lys-Pro-Trp-Arg-Trp | 2027 |
| Ala-Thr-Lys-Pro-Trp-Phe-Trp | Ala-Thr-Lys-Pro-Trp-Phe-Trp | Ala-Thr-Lys-Pro-Trp-Phe-Trp | 2028 |
| Ala-Thr-Lys-Pro-Trp-Tyr-Trp | Ala-Thr-Lys-Pro-Trp-Tyr-Trp | Ala-Thr-Lys-Pro-Trp-Tyr-Trp | 2029 |
| Ala-Thr-Lys-Pro-Trp-His-Trp | Ala-Thr-Lys-Pro-Trp-His-Trp | Ala-Thr-Lys-Pro-Trp-His-Trp | 2030 |
| Ala-Thr-Lys-Pro-Trp-Pro-Trp | Ala-Thr-Lys-Pro-Trp-Pro-Trp | Ala-Thr-Lys-Pro-Trp-Pro-Trp | 2031 |
| Ala-Thr-Lys-Pro-Trp-Lys-Trp | Ala-Thr-Lys-Pro-Trp-Lys-Trp | Ala-Thr-Lys-Pro-Trp-Lys-Trp | 2032 |
| Ala-Thr-Lys-Pro-Gln-Trp | Ala-Thr-Lys-Pro-Gln-Trp | Ala-Thr-Lys-Pro-Gln-Trp | 2033 |
| Ala-Thr-Lys-Pro-Gln-Arg-Trp | Ala-Thr-Lys-Pro-Gln-Arg-Trp | Ala-Thr-Lys-Pro-Gln-Arg-Trp | 2034 |
| Ala-Thr-Lys-Pro-Gln-Phe-Trp | Ala-Thr-Lys-Pro-Gln-Phe-Trp | Ala-Thr-Lys-Pro-Gln-Phe-Trp | 2035 |
| Ala-Thr-Lys-Pro-Gln-Tyr-Trp | Ala-Thr-Lys-Pro-Gln-Tyr-Trp | Ala-Thr-Lys-Pro-Gln-Tyr-Trp | 2036 |
| Ala-Thr-Lys-Pro-Gln-His-Trp | Ala-Thr-Lys-Pro-Gln-His-Trp | Ala-Thr-Lys-Pro-Gln-His-Trp | 2037 |
| Ala-Thr-Lys-Pro-Gln-Pro-Trp | Ala-Thr-Lys-Pro-Gln-Pro-Trp | Ala-Thr-Lys-Pro-Gln-Pro-Trp | 2038 |
| Ala-Thr-Lys-Pro-Gln-Lys-Trp | Ala-Thr-Lys-Pro-Gln-Lys-Trp | Ala-Thr-Lys-Pro-Gln-Lys-Trp | 2039 |
| Ala-Thr-Lys-Pro-Asn-Trp | Ala-Thr-Lys-Pro-Asn-Trp | Ala-Thr-Lys-Pro-Asn-Trp | 2040 |
| Ala-Thr-Lys-Pro-Asn-Arg-Trp | Ala-Thr-Lys-Pro-Asn-Arg-Trp | Ala-Thr-Lys-Pro-Asn-Arg-Trp | 2041 |
| Ala-Thr-Lys-Pro-Asn-Phe-Trp | Ala-Thr-Lys-Pro-Asn-Phe-Trp | Ala-Thr-Lys-Pro-Asn-Phe-Trp | 2042 |
| Ala-Thr-Lys-Pro-Asn-Tyr-Trp | Ala-Thr-Lys-Pro-Asn-Tyr-Trp | Ala-Thr-Lys-Pro-Asn-Tyr-Trp | 2043 |
| Ala-Thr-Lys-Pro-Asn-His-Trp | Ala-Thr-Lys-Pro-Asn-His-Trp | Ala-Thr-Lys-Pro-Asn-His-Trp | 2044 |
| Ala-Thr-Lys-Pro-Asn-Pro-Trp | Ala-Thr-Lys-Pro-Asn-Pro-Trp | Ala-Thr-Lys-Pro-Asn-Pro-Trp | 2045 |
| Ala-Thr-Lys-Pro-Asn-Lys-Trp | Ala-Thr-Lys-Pro-Asn-Lys-Trp | Ala-Thr-Lys-Pro-Asn-Lys-Trp | 2046 |
| Ala-Thr-Lys-Pro-Tyr-Trp | Ala-Thr-Lys-Pro-Tyr-Trp | Ala-Thr-Lys-Pro-Tyr-Trp | 2047 |
| Ala-Thr-Lys-Pro-Tyr-Arg-Trp | Ala-Thr-Lys-Pro-Tyr-Arg-Trp | Ala-Thr-Lys-Pro-Tyr-Arg-Trp | 2048 |
| Ala-Thr-Lys-Pro-Tyr-Phe-Trp | Ala-Thr-Lys-Pro-Tyr-Phe-Trp | Ala-Thr-Lys-Pro-Tyr-Phe-Trp | 2049 |
| Ala-Thr-Lys-Pro-Tyr-Tyr-Trp | Ala-Thr-Lys-Pro-Tyr-Tyr-Trp | Ala-Thr-Lys-Pro-Tyr-Tyr-Trp | 2050 |
| Ala-Thr-Lys-Pro-Tyr-His-Trp | Ala-Thr-Lys-Pro-Tyr-His-Trp | Ala-Thr-Lys-Pro-Tyr-His-Trp | 2051 |
| Ala-Thr-Lys-Pro-Tyr-Pro-Trp | Ala-Thr-Lys-Pro-Tyr-Pro-Trp | Ala-Thr-Lys-Pro-Tyr-Pro-Trp | 2052 |
| Ala-Thr-Lys-Pro-Tyr-Lys-Trp | Ala-Thr-Lys-Pro-Tyr-Lys-Trp | Ala-Thr-Lys-Pro-Tyr-Lys-Trp | 2053 |

TABLE 1-continued

| X-OH | X-OCH₃ | X-NH₂ | SEQ ID NO |
|---|---|---|---|
| Ala-Thr-Lys-Pro-Arg-Trp | Ala-Thr-Lys-Pro-Arg-Trp | Ala-Thr-Lys-Pro-Arg-Trp | 2054 |
| Ala-Thr-Lys-Pro-Arg-Arg-Trp | Ala-Thr-Lys-Pro-Arg-Arg-Trp | Ala-Thr-Lys-Pro-Arg-Arg-Trp | 2055 |
| Ala-Thr-Lys-Pro-Arg-Phe-Trp | Ala-Thr-Lys-Pro-Arg-Phe-Trp | Ala-Thr-Lys-Pro-Arg-Phe-Trp | 2056 |
| Ala-Thr-Lys-Pro-Arg-Tyr-Trp | Ala-Thr-Lys-Pro-Arg-Tyr-Trp | Ala-Thr-Lys-Pro-Arg-Tyr-Trp | 2057 |
| Ala-Thr-Lys-Pro-Arg-His-Trp | Ala-Thr-Lys-Pro-Arg-His-Trp | Ala-Thr-Lys-Pro-Arg-His-Trp | 2058 |
| Ala-Thr-Lys-Pro-Arg-Pro-Trp | Ala-Thr-Lys-Pro-Arg-Pro-Trp | Ala-Thr-Lys-Pro-Arg-Pro-Trp | 2059 |
| Ala-Thr-Lys-Pro-Arg-Lys-Trp | Ala-Thr-Lys-Pro-Arg-Lys-Trp | Ala-Thr-Lys-Pro-Arg-Lys-Trp | 2060 |
| His-Thr-Lys-Pro-Trp | His-Thr-Lys-Pro-Trp | His-Thr-Lys-Pro-Trp | 2061 |
| His-Thr-Lys-Pro-Arg-Trp | His-Thr-Lys-Pro-Arg-Trp | His-Thr-Lys-Pro-Arg-Trp | 2062 |
| His-Thr-Lys-Pro-Phe-Trp | His-Thr-Lys-Pro-Phe-Trp | His-Thr-Lys-Pro-Phe-Trp | 2063 |
| His-Thr-Lys-Pro-Tyr-Trp | His-Thr-Lys-Pro-Tyr-Trp | His-Thr-Lys-Pro-Tyr-Trp | 2064 |
| His-Thr-Lys-Pro-Gly-Trp | His-Thr-Lys-Pro-Gly-Trp | His-Thr-Lys-Pro-Gly-Trp | 2065 |
| His-Thr-Lys-Pro-His-Trp | His-Thr-Lys-Pro-His-Trp | His-Thr-Lys-Pro-His-Trp | 2066 |
| His-Thr-Lys-Pro-Lys-Trp | His-Thr-Lys-Pro-Lys-Trp | His-Thr-Lys-Pro-Lys-Trp | 2067 |
| His-Thr-Lys-Pro-Gly-Trp | His-Thr-Lys-Pro-Gly-Trp | His-Thr-Lys-Pro-Gly-Trp | 2068 |
| His-Thr-Lys-Pro-Gly-Arg-Trp | His-Thr-Lys-Pro-Gly-Arg-Trp | His-Thr-Lys-Pro-Gly-Arg-Trp | 2069 |
| His-Thr-Lys-Pro-Gly-Phe-Trp | His-Thr-Lys-Pro-Gly-Phe-Trp | His-Thr-Lys-Pro-Gly-Phe-Trp | 2070 |
| His-Thr-Lys-Pro-Gly-Tyr-Trp | His-Thr-Lys-Pro-Gly-Tyr-Trp | His-Thr-Lys-Pro-Gly-Tyr-Trp | 2071 |
| His-Thr-Lys-Pro-Gly-His-Trp | His-Thr-Lys-Pro-Gly-His-Trp | His-Thr-Lys-Pro-Gly-His-Trp | 2072 |
| His-Thr-Lys-Pro-Gly-Pro-Trp | His-Thr-Lys-Pro-Gly-Pro-Trp | His-Thr-Lys-Pro-Gly-Pro-Trp | 2073 |
| His-Thr-Lys-Pro-Gly-Lys-Trp | His-Thr-Lys-Pro-Gly-Lys-Trp | His-Thr-Lys-Pro-Gly-Lys-Trp | 2074 |
| His-Thr-Lys-Pro-Asp-Trp | His-Thr-Lys-Pro-Asp-Trp | His-Thr-Lys-Pro-Asp-Trp | 2075 |
| His-Thr-Lys-Pro-Asp-Arg-Trp | His-Thr-Lys-Pro-Asp-Arg-Trp | His-Thr-Lys-Pro-Asp-Arg-Trp | 2076 |
| His-Thr-Lys-Pro-Asp-Phe-Trp | His-Thr-Lys-Pro-Asp-Phe-Trp | His-Thr-Lys-Pro-Asp-Phe-Trp | 2077 |
| His-Thr-Lys-Pro-Asp-Tyr-Trp | His-Thr-Lys-Pro-Asp-Tyr-Trp | His-Thr-Lys-Pro-Asp-Tyr-Trp | 2078 |
| His-Thr-Lys-Pro-Asp-His-Trp | His-Thr-Lys-Pro-Asp-His-Trp | His-Thr-Lys-Pro-Asp-His-Trp | 2079 |
| His-Thr-Lys-Pro-Asp-Pro-Trp | His-Thr-Lys-Pro-Asp-Pro-Trp | His-Thr-Lys-Pro-Asp-Pro-Trp | 2080 |
| His-Thr-Lys-Pro-Asp-Lys-Trp | His-Thr-Lys-Pro-Asp-Lys-Trp | His-Thr-Lys-Pro-Asp-Lys-Trp | 2081 |
| His-Thr-Lys-Pro-Trp-Trp | His-Thr-Lys-Pro-Trp-Trp | His-Thr-Lys-Pro-Trp-Trp | 2082 |
| His-Thr-Lys-Pro-Trp-Arg-Trp | His-Thr-Lys-Pro-Trp-Arg-Trp | His-Thr-Lys-Pro-Trp-Arg-Trp | 2083 |
| His-Thr-Lys-Pro-Trp-Phe-Trp | His-Thr-Lys-Pro-Trp-Phe-Trp | His-Thr-Lys-Pro-Trp-Phe-Trp | 2084 |
| His-Thr-Lys-Pro-Trp-Tyr-Trp | His-Thr-Lys-Pro-Trp-Tyr-Trp | His-Thr-Lys-Pro-Trp-Tyr-Trp | 2085 |
| His-Thr-Lys-Pro-Trp-His-Trp | His-Thr-Lys-Pro-Trp-His-Trp | His-Thr-Lys-Pro-Trp-His-Trp | 2086 |
| His-Thr-Lys-Pro-Trp-Pro-Trp | His-Thr-Lys-Pro-Trp-Pro-Trp | His-Thr-Lys-Pro-Trp-Pro-Trp | 2087 |
| His-Thr-Lys-Pro-Trp-Lys-Trp | His-Thr-Lys-Pro-Trp-Lys-Trp | His-Thr-Lys-Pro-Trp-Lys-Trp | 2088 |
| His-Thr-Lys-Pro-Gln-Trp | His-Thr-Lys-Pro-Gln-Trp | His-Thr-Lys-Pro-Gln-Trp | 2089 |
| His-Thr-Lys-Pro-Gln-Arg-Trp | His-Thr-Lys-Pro-Gln-Arg-Trp | His-Thr-Lys-Pro-Gln-Arg-Trp | 2090 |
| His-Thr-Lys-Pro-Gln-Phe-Trp | His-Thr-Lys-Pro-Gln-Phe-Trp | His-Thr-Lys-Pro-Gln-Phe-Trp | 2091 |

TABLE 1-continued

| X-OH | X-OCH₃ | X-NH₂ | SEQ ID NO |
|---|---|---|---|
| His-Thr-Lys-Pro-Gln-Tyr-Trp | His-Thr-Lys-Pro-Gln-Tyr-Trp | His-Thr-Lys-Pro-Gln-Tyr-Trp | 2092 |
| His-Thr-Lys-Pro-Gln-His-Trp | His-Thr-Lys-Pro-Gln-His-Trp | His-Thr-Lys-Pro-Gln-His-Trp | 2093 |
| His-Thr-Lys-Pro-Gln-Pro-Trp | His-Thr-Lys-Pro-Gln-Pro-Trp | His-Thr-Lys-Pro-Gln-Pro-Trp | 2094 |
| His-Thr-Lys-Pro-Gln-Lys-Trp | His-Thr-Lys-Pro-Gln-Lys-Trp | His-Thr-Lys-Pro-Gln-Lys-Trp | 2095 |
| His-Thr-Lys-Pro-Asn-Trp | His-Thr-Lys-Pro-Asn-Trp | His-Thr-Lys-Pro-Asn-Trp | 2096 |
| His-Thr-Lys-Pro-Asn-Arg-Trp | His-Thr-Lys-Pro-Asn-Arg-Trp | His-Thr-Lys-Pro-Asn-Arg-Trp | 2097 |
| His-Thr-Lys-Pro-Asn-Phe-Trp | His-Thr-Lys-Pro-Asn-Phe-Trp | His-Thr-Lys-Pro-Asn-Phe-Trp | 2098 |
| His-Thr-Lys-Pro-Asn-Tyr-Trp | His-Thr-Lys-Pro-Asn-Tyr-Trp | His-Thr-Lys-Pro-Asn-Tyr-Trp | 2099 |
| His-Thr-Lys-Pro-Asn-His-Trp | His-Thr-Lys-Pro-Asn-His-Trp | His-Thr-Lys-Pro-Asn-His-Trp | 2100 |
| His-Thr-Lys-Pro-Asn-Pro-Trp | His-Thr-Lys-Pro-Asn-Pro-Trp | His-Thr-Lys-Pro-Asn-Pro-Trp | 2101 |
| His-Thr-Lys-Pro-Asn-Lys-Trp | His-Thr-Lys-Pro-Asn-Lys-Trp | His-Thr-Lys-Pro-Asn-Lys-Trp | 2102 |
| His-Thr-Lys-Pro-Tyr-Trp | His-Thr-Lys-Pro-Tyr-Trp | His-Thr-Lys-Pro-Tyr-Trp | 2103 |
| His-Thr-Lys-Pro-Tyr-Arg-Trp | His-Thr-Lys-Pro-Tyr-Arg-Trp | His-Thr-Lys-Pro-Tyr-Arg-Trp | 2104 |
| His-Thr-Lys-Pro-Tyr-Phe-Trp | His-Thr-Lys-Pro-Tyr-Phe-Trp | His-Thr-Lys-Pro-Tyr-Phe-Trp | 2105 |
| His-Thr-Lys-Pro-Tyr-Tyr-Trp | His-Thr-Lys-Pro-Tyr-Tyr-Trp | His-Thr-Lys-Pro-Tyr-Tyr-Trp | 2106 |
| His-Thr-Lys-Pro-Tyr-His-Trp | His-Thr-Lys-Pro-Tyr-His-Trp | His-Thr-Lys-Pro-Tyr-His-Trp | 2107 |
| His-Thr-Lys-Pro-Tyr-Pro-Trp | His-Thr-Lys-Pro-Tyr-Pro-Trp | His-Thr-Lys-Pro-Tyr-Pro-Trp | 2108 |
| His-Thr-Lys-Pro-Tyr-Lys-Trp | His-Thr-Lys-Pro-Tyr-Lys-Trp | His-Thr-Lys-Pro-Tyr-Lys-Trp | 2109 |
| His-Thr-Lys-Pro-Arg-Trp | His-Thr-Lys-Pro-Arg-Trp | His-Thr-Lys-Pro-Arg-Trp | 2110 |
| His-Thr-Lys-Pro-Arg-Arg-Trp | His-Thr-Lys-Pro-Arg-Arg-Trp | His-Thr-Lys-Pro-Arg-Arg-Trp | 2111 |
| His-Thr-Lys-Pro-Arg-Phe-Trp | His-Thr-Lys-Pro-Arg-Phe-Trp | His-Thr-Lys-Pro-Arg-Phe-Trp | 2112 |
| His-Thr-Lys-Pro-Arg-Tyr-Trp | His-Thr-Lys-Pro-Arg-Tyr-Trp | His-Thr-Lys-Pro-Arg-Tyr-Trp | 2113 |
| His-Thr-Lys-Pro-Arg-His-Trp | His-Thr-Lys-Pro-Arg-His-Trp | His-Thr-Lys-Pro-Arg-His-Trp | 2114 |
| His-Thr-Lys-Pro-Arg-Pro-Trp | His-Thr-Lys-Pro-Arg-Pro-Trp | His-Thr-Lys-Pro-Arg-Pro-Trp | 2115 |
| His-Thr-Lys-Pro-Arg-Lys-Trp | His-Thr-Lys-Pro-Arg-Lys-Trp | His-Thr-Lys-Pro-Arg-Lys-Trp | 2116 |
| Lys-Thr-Lys-Pro-Trp | Lys-Thr-Lys-Pro-Trp | Lys-Thr-Lys-Pro-Trp | 2117 |
| Lys-Thr-Lys-Pro-Arg-Trp | Lys-Thr-Lys-Pro-Arg-Trp | Lys-Thr-Lys-Pro-Arg-Trp | 2118 |
| Lys-Thr-Lys-Pro-Phe-Trp | Lys-Thr-Lys-Pro-Phe-Trp | Lys-Thr-Lys-Pro-Phe-Trp | 2119 |
| Lys-Thr-Lys-Pro-Tyr-Trp | Lys-Thr-Lys-Pro-Tyr-Trp | Lys-Thr-Lys-Pro-Tyr-Trp | 2120 |
| Lys-Thr-Lys-Pro-Gly-Trp | Lys-Thr-Lys-Pro-Gly-Trp | Lys-Thr-Lys-Pro-Gly-Trp | 2121 |
| Lys-Thr-Lys-Pro-His-Trp | Lys-Thr-Lys-Pro-His-Trp | Lys-Thr-Lys-Pro-His-Trp | 2122 |
| Lys-Thr-Lys-Pro-Lys-Trp | Lys-Thr-Lys-Pro-Lys-Trp | Lys-Thr-Lys-Pro-Lys-Trp | 2123 |
| Lys-Thr-Lys-Pro-Gly-Trp | Lys-Thr-Lys-Pro-Gly-Trp | Lys-Thr-Lys-Pro-Gly-Trp | 2124 |
| Lys-Thr-Lys-Pro-Gly-Arg-Trp | Lys-Thr-Lys-Pro-Gly-Arg-Trp | Lys-Thr-Lys-Pro-Gly-Arg-Trp | 2125 |
| Lys-Thr-Lys-Pro-Gly-Phe-Trp | Lys-Thr-Lys-Pro-Gly-Phe-Trp | Lys-Thr-Lys-Pro-Gly-Phe-Trp | 2126 |
| Lys-Thr-Lys-Pro-Gly-Tyr-Trp | Lys-Thr-Lys-Pro-Gly-Tyr-Trp | Lys-Thr-Lys-Pro-Gly-Tyr-Trp | 2127 |
| Lys-Thr-Lys-Pro-Gly-His-Trp | Lys-Thr-Lys-Pro-Gly-His-Trp | Lys-Thr-Lys-Pro-Gly-His-Trp | 2128 |
| Lys-Thr-Lys-Pro-Gly-Pro-Trp | Lys-Thr-Lys-Pro-Gly-Pro-Trp | Lys-Thr-Lys-Pro-Gly-Pro-Trp | 2129 |

TABLE 1-continued

| X-OH | X-OCH₃ | X-NH₂ | SEQ ID NO |
|---|---|---|---|
| Lys-Thr-Lys-Pro-Gly-Lys-Trp | Lys-Thr-Lys-Pro-Gly-Lys-Trp | Lys-Thr-Lys-Pro-Gly-Lys-Trp | 2130 |
| Lys-Thr-Lys-Pro-Asp-Trp | Lys-Thr-Lys-Pro-Asp-Trp | Lys-Thr-Lys-Pro-Asp-Trp | 2131 |
| Lys-Thr-Lys-Pro-Asp-Arg-Trp | Lys-Thr-Lys-Pro-Asp-Arg-Trp | Lys-Thr-Lys-Pro-Asp-Arg-Trp | 2132 |
| Lys-Thr-Lys-Pro-Asp-Phe-Trp | Lys-Thr-Lys-Pro-Asp-Phe-Trp | Lys-Thr-Lys-Pro-Asp-Phe-Trp | 2133 |
| Lys-Thr-Lys-Pro-Asp-Tyr-Trp | Lys-Thr-Lys-Pro-Asp-Tyr-Trp | Lys-Thr-Lys-Pro-Asp-Tyr-Trp | 2134 |
| Lys-Thr-Lys-Pro-Asp-His-Trp | Lys-Thr-Lys-Pro-Asp-His-Trp | Lys-Thr-Lys-Pro-Asp-His-Trp | 2135 |
| Lys-Thr-Lys-Pro-Asp-Pro-Trp | Lys-Thr-Lys-Pro-Asp-Pro-Trp | Lys-Thr-Lys-Pro-Asp-Pro-Trp | 2136 |
| Lys-Thr-Lys-Pro-Asp-Lys-Trp | Lys-Thr-Lys-Pro-Asp-Lys-Trp | Lys-Thr-Lys-Pro-Asp-Lys-Trp | 2137 |
| Lys-Thr-Lys-Pro-Trp-Trp | Lys-Thr-Lys-Pro-Trp-Trp | Lys-Thr-Lys-Pro-Trp-Trp | 2138 |
| Lys-Thr-Lys-Pro-Trp-Arg-Trp | Lys-Thr-Lys-Pro-Trp-Arg-Trp | Lys-Thr-Lys-Pro-Trp-Arg-Trp | 2139 |
| Lys-Thr-Lys-Pro-Trp-Phe-Trp | Lys-Thr-Lys-Pro-Trp-Phe-Trp | Lys-Thr-Lys-Pro-Trp-Phe-Trp | 2140 |
| Lys-Thr-Lys-Pro-Trp-Tyr-Trp | Lys-Thr-Lys-Pro-Trp-Tyr-Trp | Lys-Thr-Lys-Pro-Trp-Tyr-Trp | 2141 |
| Lys-Thr-Lys-Pro-Trp-His-Trp | Lys-Thr-Lys-Pro-Trp-His-Trp | Lys-Thr-Lys-Pro-Trp-His-Trp | 2142 |
| Lys-Thr-Lys-Pro-Trp-Pro-Trp | Lys-Thr-Lys-Pro-Trp-Pro-Trp | Lys-Thr-Lys-Pro-Trp-Pro-Trp | 2143 |
| Lys-Thr-Lys-Pro-Trp-Lys-Trp | Lys-Thr-Lys-Pro-Trp-Lys-Trp | Lys-Thr-Lys-Pro-Trp-Lys-Trp | 2144 |
| Lys-Thr-Lys-Pro-Gln-Trp | Lys-Thr-Lys-Pro-Gln-Trp | Lys-Thr-Lys-Pro-Gln-Trp | 2145 |
| Lys-Thr-Lys-Pro-Gln-Arg-Trp | Lys-Thr-Lys-Pro-Gln-Arg-Trp | Lys-Thr-Lys-Pro-Gln-Arg-Trp | 2146 |
| Lys-Thr-Lys-Pro-Gln-Phe-Trp | Lys-Thr-Lys-Pro-Gln-Phe-Trp | Lys-Thr-Lys-Pro-Gln-Phe-Trp | 2147 |
| Lys-Thr-Lys-Pro-Gln-Tyr-Trp | Lys-Thr-Lys-Pro-Gln-Tyr-Trp | Lys-Thr-Lys-Pro-Gln-Tyr-Trp | 2148 |
| Lys-Thr-Lys-Pro-Gln-His-Trp | Lys-Thr-Lys-Pro-Gln-His-Trp | Lys-Thr-Lys-Pro-Gln-His-Trp | 2149 |
| Lys-Thr-Lys-Pro-Gln-Pro-Trp | Lys-Thr-Lys-Pro-Gln-Pro-Trp | Lys-Thr-Lys-Pro-Gln-Pro-Trp | 2150 |
| Lys-Thr-Lys-Pro-Gln-Lys-Trp | Lys-Thr-Lys-Pro-Gln-Lys-Trp | Lys-Thr-Lys-Pro-Gln-Lys-Trp | 2151 |
| Lys-Thr-Lys-Pro-Asn-Trp | Lys-Thr-Lys-Pro-Asn-Trp | Lys-Thr-Lys-Pro-Asn-Trp | 2152 |
| Lys-Thr-Lys-Pro-Asn-Arg-Trp | Lys-Thr-Lys-Pro-Asn-Arg-Trp | Lys-Thr-Lys-Pro-Asn-Arg-Trp | 2153 |
| Lys-Thr-Lys-Pro-Asn-Phe-Trp | Lys-Thr-Lys-Pro-Asn-Phe-Trp | Lys-Thr-Lys-Pro-Asn-Phe-Trp | 2154 |
| Lys-Thr-Lys-Pro-Asn-Tyr-Trp | Lys-Thr-Lys-Pro-Asn-Tyr-Trp | Lys-Thr-Lys-Pro-Asn-Tyr-Trp | 2155 |
| Lys-Thr-Lys-Pro-Asn-His-Trp | Lys-Thr-Lys-Pro-Asn-His-Trp | Lys-Thr-Lys-Pro-Asn-His-Trp | 2156 |
| Lys-Thr-Lys-Pro-Asn-Pro-Trp | Lys-Thr-Lys-Pro-Asn-Pro-Trp | Lys-Thr-Lys-Pro-Asn-Pro-Trp | 2157 |
| Lys-Thr-Lys-Pro-Asn-Lys-Trp | Lys-Thr-Lys-Pro-Asn-Lys-Trp | Lys-Thr-Lys-Pro-Asn-Lys-Trp | 2158 |
| Lys-Thr-Lys-Pro-Tyr-Trp | Lys-Thr-Lys-Pro-Tyr-Trp | Lys-Thr-Lys-Pro-Tyr-Trp | 2159 |
| Lys-Thr-Lys-Pro-Tyr-Arg-Tr pLys-Thr-Lys-Pro-Tyr-Arg-Trp | Lys-Thr-Lys-Pro-Tyr-Arg-Trp | 2160 |
| Lys-Thr-Lys-Pro-Tyr-Phe-Tr pLys-Thr-Lys-Pro-Tyr-Phe-Trp | Lys-Thr-Lys-Pro-Tyr-Phe-Trp | 2161 |
| Lys-Thr-Lys-Pro-Tyr-Tyr-Tr pLys-Thr-Lys-Pro-Tyr-Tyr-Trp | Lys-Thr-Lys-Pro-Tyr-Tyr-Trp | 2162 |
| Lys-Thr-Lys-Pro-Tyr-His-Tr pLys-Thr-Lys-Pro-Tyr-His-Trp | Lys-Thr-Lys-Pro-Tyr-His-Trp | 2163 |
| Lys-Thr-Lys-Pro-Tyr-Pro-Tr pLys-Thr-Lys-Pro-Tyr-Pro-Trp | Lys-Thr-Lys-Pro-Tyr-Pro-Trp | 2164 |
| Lys-Thr-Lys-Pro-Tyr-Lys-Tr pLys-Thr-Lys-Pro-Tyr-Lys-Trp | Lys-Thr-Lys-Pro-Tyr-Lys-Trp | 2165 |
| Lys-Thr-Lys-Pro-Arg-Trp | Lys-Thr-Lys-Pro-Arg-Trp | Lys-Thr-Lys-Pro-Arg-Trp | 2166 |
| Lys-Thr-Lys-Pro-Arg-Arg-Trp | Lys-Thr-Lys-Pro-Arg-Arg-Trp | Lys-Thr-Lys-Pro-Arg-Arg-Trp | 2167 |

TABLE 1-continued

| X-OH | X-OCH₃ | X-NH₂ | SEQ ID NO |
|---|---|---|---|
| Lys-Thr-Lys-Pro-Arg-Phe-Trp | Lys-Thr-Lys-Pro-Arg-Phe-Trp | Lys-Thr-Lys-Pro-Arg-Phe-Trp | 2168 |
| Lys-Thr-Lys-Pro-Arg-Tyr-Trp | Lys-Thr-Lys-Pro-Arg-Tyr-Trp | Lys-Thr-Lys-Pro-Arg-Tyr-Trp | 2169 |
| Lys-Thr-Lys-Pro-Arg-His-Trp | Lys-Thr-Lys-Pro-Arg-His-Trp | Lys-Thr-Lys-Pro-Arg-His-Trp | 2170 |
| Lys-Thr-Lys-Pro-Arg-Pro-Trp | Lys-Thr-Lys-Pro-Arg-Pro-Trp | Lys-Thr-Lys-Pro-Arg-Pro-Trp | 2171 |
| Lys-Thr-Lys-Pro-Arg-Lys-Trp | Lys-Thr-Lys-Pro-Arg-Lys-Trp | Lys-Thr-Lys-Pro-Arg-Lys-Trp | 2172 |
| Gly-Thr-Lys-Pro-Trp | Gly-Thr-Lys-Pro-Trp | Gly-Thr-Lys-Pro-Trp | 2173 |
| Gly-Thr-Lys-Pro-Arg-Trp | Gly-Thr-Lys-Pro-Arg-Trp | Gly-Thr-Lys-Pro-Arg-Trp | 2174 |
| Gly-Thr-Lys-Pro-Phe-Trp | Gly-Thr-Lys-Pro-Phe-Trp | Gly-Thr-Lys-Pro-Phe-Trp | 2175 |
| Gly-Thr-Lys-Pro-Tyr-Trp | Gly-Thr-Lys-Pro-Tyr-Trp | Gly-Thr-Lys-Pro-Tyr-Trp | 2176 |
| Gly-Thr-Lys-Pro-Gly-Trp | Gly-Thr-Lys-Pro-Gly-Trp | Gly-Thr-Lys-Pro-Gly-Trp | 2177 |
| Gly-Thr-Lys-Pro-His-Trp | Gly-Thr-Lys-Pro-His-Trp | Gly-Thr-Lys-Pro-His-Trp | 2178 |
| Gly-Thr-Lys-Pro-Lys-Trp | Gly-Thr-Lys-Pro-Lys-Trp | Gly-Thr-Lys-Pro-Lys-Trp | 2179 |
| Gly-Thr-Lys-Pro-Gly-Trp | Gly-Thr-Lys-Pro-Gly-Trp | Gly-Thr-Lys-Pro-Gly-Trp | 2180 |
| Gly-Thr-Lys-Pro-Gly-Arg-Trp | Gly-Thr-Lys-Pro-Gly-Arg-Trp | Gly-Thr-Lys-Pro-Gly-Arg-Trp | 2181 |
| Gly-Thr-Lys-Pro-Gly-Phe-Trp | Gly-Thr-Lys-Pro-Gly-Phe-Trp | Gly-Thr-Lys-Pro-Gly-Phe-Trp | 2182 |
| Gly-Thr-Lys-Pro-Gly-Tyr-Trp | Gly-Thr-Lys-Pro-Gly-Tyr-Trp | Gly-Thr-Lys-Pro-Gly-Tyr-Trp | 2183 |
| Gly-Thr-Lys-Pro-Gly-His-Trp | Gly-Thr-Lys-Pro-Gly-His-Trp | Gly-Thr-Lys-Pro-Gly-His-Trp | 2184 |
| Gly-Thr-Lys-Pro-Gly-Pro-Trp | Gly-Thr-Lys-Pro-Gly-Pro-Trp | Gly-Thr-Lys-Pro-Gly-Pro-Trp | 2185 |
| Gly-Thr-Lys-Pro-Gly-Lys-Trp | Gly-Thr-Lys-Pro-Gly-Lys-Trp | Gly-Thr-Lys-Pro-Gly-Lys-Trp | 2186 |
| Gly-Thr-Lys-Pro-Asp-Trp | Gly-Thr-Lys-Pro-Asp-Trp | Gly-Thr-Lys-Pro-Asp-Trp | 2187 |
| Gly-Thr-Lys-Pro-Asp-Arg-Trp | Gly-Thr-Lys-Pro-Asp-Arg-Trp | Gly-Thr-Lys-Pro-Asp-Arg-Trp | 2188 |
| Gly-Thr-Lys-Pro-Asp-Phe-Trp | Gly-Thr-Lys-Pro-Asp-Phe-Trp | Gly-Thr-Lys-Pro-Asp-Phe-Trp | 2189 |
| Gly-Thr-Lys-Pro-Asp-Tyr-Trp | Gly-Thr-Lys-Pro-Asp-Tyr-Trp | Gly-Thr-Lys-Pro-Asp-Tyr-Trp | 2190 |
| Gly-Thr-Lys-Pro-Asp-His-Trp | Gly-Thr-Lys-Pro-Asp-His-Trp | Gly-Thr-Lys-Pro-Asp-His-Trp | 2191 |
| Gly-Thr-Lys-Pro-Asp-Pro-Trp | Gly-Thr-Lys-Pro-Asp-Pro-Trp | Gly-Thr-Lys-Pro-Asp-Pro-Trp | 2192 |
| Gly-Thr-Lys-Pro-Asp-Lys-Trp | Gly-Thr-Lys-Pro-Asp-Lys-Trp | Gly-Thr-Lys-Pro-Asp-Lys-Trp | 2193 |
| Gly-Thr-Lys-Pro-Trp-Trp | Gly-Thr-Lys-Pro-Trp-Trp | Gly-Thr-Lys-Pro-Trp-Trp | 2194 |
| Gly-Thr-Lys-Pro-Trp-Arg-Trp | Gly-Thr-Lys-Pro-Trp-Arg-Trp | Gly-Thr-Lys-Pro-Trp-Arg-Trp | 2195 |
| Gly-Thr-Lys-Pro-Trp-Phe-Trp | Gly-Thr-Lys-Pro-Trp-Phe-Trp | Gly-Thr-Lys-Pro-Trp-Phe-Trp | 2196 |
| Gly-Thr-Lys-Pro-Trp-Tyr-Trp | Gly-Thr-Lys-Pro-Trp-Tyr-Trp | Gly-Thr-Lys-Pro-Trp-Tyr-Trp | 2197 |
| Gly-Thr-Lys-Pro-Trp-His-Trp | Gly-Thr-Lys-Pro-Trp-His-Trp | Gly-Thr-Lys-Pro-Trp-His-Trp | 2198 |
| Gly-Thr-Lys-Pro-Trp-Pro-Trp | Gly-Thr-Lys-Pro-Trp-Pro-Trp | Gly-Thr-Lys-Pro-Trp-Pro-Trp | 2199 |
| Gly-Thr-Lys-Pro-Trp-Lys-Trp | Gly-Thr-Lys-Pro-Trp-Lys-Trp | Gly-Thr-Lys-Pro-Trp-Lys-Trp | 2200 |
| Gly-Thr-Lys-Pro-Gln-Trp | Gly-Thr-Lys-Pro-Gln-Trp | Gly-Thr-Lys-Pro-Gln-Trp | 2201 |
| Gly-Thr-Lys-Pro-Gln-Arg-Trp | Gly-Thr-Lys-Pro-Gln-Arg-Trp | Gly-Thr-Lys-Pro-Gln-Arg-Trp | 2202 |
| Gly-Thr-Lys-Pro-Gln-Phe-Trp | Gly-Thr-Lys-Pro-Gln-Phe-Trp | Gly-Thr-Lys-Pro-Gln-Phe-Trp | 2203 |
| Gly-Thr-Lys-Pro-Gln-Tyr-Trp | Gly-Thr-Lys-Pro-Gln-Tyr-Trp | Gly-Thr-Lys-Pro-Gln-Tyr-Trp | 2204 |
| Gly-Thr-Lys-Pro-Gln-His-Trp | Gly-Thr-Lys-Pro-Gln-His-Trp | Gly-Thr-Lys-Pro-Gln-His-Trp | 2205 |

TABLE 1-continued

| X-OH | X-OCH₃ | X-NH₂ | SEQ ID NO |
|---|---|---|---|
| Gly-Thr-Lys-Pro-Gln-Pro-Trp | Gly-Thr-Lys-Pro-Gln-Pro-Trp | Gly-Thr-Lys-Pro-Gln-Pro-Trp | 2206 |
| Gly-Thr-Lys-Pro-Gln-Lys-Trp | Gly-Thr-Lys-Pro-Gln-Lys-Trp | Gly-Thr-Lys-Pro-Gln-Lys-Trp | 2207 |
| Gly-Thr-Lys-Pro-Asn-Trp | Gly-Thr-Lys-Pro-Asn-Trp | Gly-Thr-Lys-Pro-Asn-Trp | 2208 |
| Gly-Thr-Lys-Pro-Asn-Arg-Trp | Gly-Thr-Lys-Pro-Asn-Arg-Trp | Gly-Thr-Lys-Pro-Asn-Arg-Trp | 2209 |
| Gly-Thr-Lys-Pro-Asn-Phe-Trp | Gly-Thr-Lys-Pro-Asn-Phe-Trp | Gly-Thr-Lys-Pro-Asn-Phe-Trp | 2210 |
| Gly-Thr-Lys-Pro-Asn-Tyr-Trp | Gly-Thr-Lys-Pro-Asn-Tyr-Trp | Gly-Thr-Lys-Pro-Asn-Tyr-Trp | 2211 |
| Gly-Thr-Lys-Pro-Asn-His-Trp | Gly-Thr-Lys-Pro-Asn-His-Trp | Gly-Thr-Lys-Pro-Asn-His-Trp | 2212 |
| Gly-Thr-Lys-Pro-Asn-Pro-Trp | Gly-Thr-Lys-Pro-Asn-Pro-Trp | Gly-Thr-Lys-Pro-Asn-Pro-Trp | 2213 |
| Gly-Thr-Lys-Pro-Asn-Lys-Trp | Gly-Thr-Lys-Pro-Asn-Lys-Trp | Gly-Thr-Lys-Pro-Asn-Lys-Trp | 2214 |
| Gly-Thr-Lys-Pro-Tyr-Trp | Gly-Thr-Lys-Pro-Tyr-Trp | Gly-Thr-Lys-Pro-Tyr-Trp | 2215 |
| Gly-Thr-Lys-Pro-Tyr-Arg-Trp | Gly-Thr-Lys-Pro-Tyr-Arg-Trp | Gly-Thr-Lys-Pro-Tyr-Arg-Trp | 2216 |
| Gly-Thr-Lys-Pro-Tyr-Phe-Trp | Gly-Thr-Lys-Pro-Tyr-Phe-Trp | Gly-Thr-Lys-Pro-Tyr-Phe-Trp | 2217 |
| Gly-Thr-Lys-Pro-Tyr-Tyr-Trp | Gly-Thr-Lys-Pro-Tyr-Tyr-Trp | Gly-Thr-Lys-Pro-Tyr-Tyr-Trp | 2218 |
| Gly-Thr-Lys-Pro-Tyr-His-Trp | Gly-Thr-Lys-Pro-Tyr-His-Trp | Gly-Thr-Lys-Pro-Tyr-His-Trp | 2219 |
| Gly-Thr-Lys-Pro-Tyr-Pro-Trp | Gly-Thr-Lys-Pro-Tyr-Pro-Trp | Gly-Thr-Lys-Pro-Tyr-Pro-Trp | 2220 |
| Gly-Thr-Lys-Pro-Tyr-Lys-Trp | Gly-Thr-Lys-Pro-Tyr-Lys-Trp | Gly-Thr-Lys-Pro-Tyr-Lys-Trp | 2221 |
| Gly-Thr-Lys-Pro-Arg-Trp | Gly-Thr-Lys-Pro-Arg-Trp | Gly-Thr-Lys-Pro-Arg-Trp | 2222 |
| Gly-Thr-Lys-Pro-Arg-Arg-Trp | Gly-Thr-Lys-Pro-Arg-Arg-Trp | Gly-Thr-Lys-Pro-Arg-Arg-Trp | 2223 |
| Gly-Thr-Lys-Pro-Arg-Phe-Trp | Gly-Thr-Lys-Pro-Arg-Phe-Trp | Gly-Thr-Lys-Pro-Arg-Phe-Trp | 2224 |
| Gly-Thr-Lys-Pro-Arg-Tyr-Trp | Gly-Thr-Lys-Pro-Arg-Tyr-Trp | Gly-Thr-Lys-Pro-Arg-Tyr-Trp | 2225 |
| Gly-Thr-Lys-Pro-Arg-His-Trp | Gly-Thr-Lys-Pro-Arg-His-Trp | Gly-Thr-Lys-Pro-Arg-His-Trp | 2226 |
| Gly-Thr-Lys-Pro-Arg-Pro-Trp | Gly-Thr-Lys-Pro-Arg-Pro-Trp | Gly-Thr-Lys-Pro-Arg-Pro-Trp | 2227 |
| Gly-Thr-Lys-Pro-Arg-Lys-Trp | Gly-Thr-Lys-Pro-Arg-Lys-Trp | Gly-Thr-Lys-Pro-Arg-Lys-Trp | 2228 |
| Thr-Lys-Pro-Arg-Phe | Thr-Lys-Pro-Arg-Phe | Thr-Lys-Pro-Arg-Phe | 2229 |
| Thr-Lys-Pro-Phe-Phe | Thr-Lys-Pro-Phe-Phe | Thr-Lys-Pro-Phe-Phe | 2230 |
| Thr-Lys-Pro-Tyr-Phe | Thr-Lys-Pro-Tyr-Phe | Thr-Lys-Pro-Tyr-Phe | 2231 |
| Thr-Lys-Pro-Gly-Phe | Thr-Lys-Pro-Gly-Phe | Thr-Lys-Pro-Gly-Phe | 2232 |
| Thr-Lys-Pro-His-Phe | Thr-Lys-Pro-His-Phe | Thr-Lys-Pro-His-Phe | 2233 |
| Thr-Lys-Pro-Lys-Phe | Thr-Lys-Pro-Lys-Phe | Thr-Lys-Pro-Lys-Phe | 2234 |
| Thr-Lys-Pro-Gly-Phe | Thr-Lys-Pro-Gly-Phe | Thr-Lys-Pro-Gly-Phe | 2235 |
| Thr-Lys-Pro-Gly-Arg-Phe | Thr-Lys-Pro-Gly-Arg-Phe | Thr-Lys-Pro-Gly-Arg-Phe | 2236 |
| Thr-Lys-Pro-Gly-Phe-Phe | Thr-Lys-Pro-Gly-Phe-Phe | Thr-Lys-Pro-Gly-Phe-Phe | 2237 |
| Thr-Lys-Pro-Gly-Tyr-Phe | Thr-Lys-Pro-Gly-Tyr-Phe | Thr-Lys-Pro-Gly-Tyr-Phe | 2238 |
| Thr-Lys-Pro-Gly-His-Phe | Thr-Lys-Pro-Gly-His-Phe | Thr-Lys-Pro-Gly-His-Phe | 2239 |
| Thr-Lys-Pro-Gly-Pro-Phe | Thr-Lys-Pro-Gly-Pro-Phe | Thr-Lys-Pro-Gly-Pro-Phe | 2240 |
| Thr-Lys-Pro-Gly-Lys-Phe | Thr-Lys-Pro-Gly-Lys-Phe | Thr-Lys-Pro-Gly-Lys-Phe | 2241 |
| Thr-Lys-Pro-Asp-Phe | Thr-Lys-Pro-Asp-Phe | Thr-Lys-Pro-Asp-Phe | 2242 |
| Thr-Lys-Pro-Asp-Arg-Phe | Thr-Lys-Pro-Asp-Arg-Phe | Thr-Lys-Pro-Asp-Arg-Phe | 2243 |

TABLE 1-continued

| X-OH | X-OCH₃ | X-NH₂ | SEQ ID NO |
|---|---|---|---|
| Thr-Lys-Pro-Asp-Phe-Phe | Thr-Lys-Pro-Asp-Phe-Phe | Thr-Lys-Pro-Asp-Phe-Phe | 2244 |
| Thr-Lys-Pro-Asp-Tyr-Phe | Thr-Lys-Pro-Asp-Tyr-Phe | Thr-Lys-Pro-Asp-Tyr-Phe | 2245 |
| Thr-Lys-Pro-Asp-His-Phe | Thr-Lys-Pro-Asp-His-Phe | Thr-Lys-Pro-Asp-His-Phe | 2246 |
| Thr-Lys-Pro-Asp-Pro-Phe | Thr-Lys-Pro-Asp-Pro-Phe | Thr-Lys-Pro-Asp-Pro-Phe | 2247 |
| Thr-Lys-Pro-Asp-Lys-Phe | Thr-Lys-Pro-Asp-Lys-Phe | Thr-Lys-Pro-Asp-Lys-Phe | 2248 |
| Thr-Lys-Pro-Trp-Phe | Thr-Lys-Pro-Trp-Phe | Thr-Lys-Pro-Trp-Phe | 2249 |
| Thr-Lys-Pro-Trp-Arg-Phe | Thr-Lys-Pro-Trp-Arg-Phe | Thr-Lys-Pro-Trp-Arg-Phe | 2250 |
| Thr-Lys-Pro-Trp-Phe-Phe | Thr-Lys-Pro-Trp-Phe-Phe | Thr-Lys-Pro-Trp-Phe-Phe | 2251 |
| Thr-Lys-Pro-Trp-Tyr-Phe | Thr-Lys-Pro-Trp-Tyr-Phe | Thr-Lys-Pro-Trp-Tyr-Phe | 2252 |
| Thr-Lys-Pro-Trp-His-Phe | Thr-Lys-Pro-Trp-His-Phe | Thr-Lys-Pro-Trp-His-Phe | 2253 |
| Thr-Lys-Pro-Trp-Pro-Phe | Thr-Lys-Pro-Trp-Pro-Phe | Thr-Lys-Pro-Trp-Pro-Phe | 2254 |
| Thr-Lys-Pro-Trp-Lys-Phe | Thr-Lys-Pro-Trp-Lys-Phe | Thr-Lys-Pro-Trp-Lys-Phe | 2255 |
| Thr-Lys-Pro-Gln-Phe | Thr-Lys-Pro-Gln-Phe | Thr-Lys-Pro-Gln-Phe | 2256 |
| Thr-Lys-Pro-Gln-Arg-Phe | Thr-Lys-Pro-Gln-Arg-Phe | Thr-Lys-Pro-Gln-Arg-Phe | 2257 |
| Thr-Lys-Pro-Gln-Phe-Phe | Thr-Lys-Pro-Gln-Phe-Phe | Thr-Lys-Pro-Gln-Phe-Phe | 2258 |
| Thr-Lys-Pro-Gln-Tyr-Phe | Thr-Lys-Pro-Gln-Tyr-Phe | Thr-Lys-Pro-Gln-Tyr-Phe | 2259 |
| Thr-Lys-Pro-Gln-His-Phe | Thr-Lys-Pro-Gln-His-Phe | Thr-Lys-Pro-Gln-His-Phe | 2260 |
| Thr-Lys-Pro-Gln-Pro-Phe | Thr-Lys-Pro-Gln-Pro-Phe | Thr-Lys-Pro-Gln-Pro-Phe | 2261 |
| Thr-Lys-Pro-Gln-Lys-Phe | Thr-Lys-Pro-Gln-Lys-Phe | Thr-Lys-Pro-Gln-Lys-Phe | 2262 |
| Thr-Lys-Pro-Asn-Phe | Thr-Lys-Pro-Asn-Phe | Thr-Lys-Pro-Asn-Phe | 2263 |
| Thr-Lys-Pro-Asn-Arg-Phe | Thr-Lys-Pro-Asn-Arg-Phe | Thr-Lys-Pro-Asn-Arg-Phe | 2264 |
| Thr-Lys-Pro-Asn-Phe-Phe | Thr-Lys-Pro-Asn-Phe-Phe | Thr-Lys-Pro-Asn-Phe-Phe | 2265 |
| Thr-Lys-Pro-Asn-Tyr-Phe | Thr-Lys-Pro-Asn-Tyr-Phe | Thr-Lys-Pro-Asn-Tyr-Phe | 2266 |
| Thr-Lys-Pro-Asn-His-Phe | Thr-Lys-Pro-Asn-His-Phe | Thr-Lys-Pro-Asn-His-Phe | 2267 |
| Thr-Lys-Pro-Asn-Pro-Phe | Thr-Lys-Pro-Asn-Pro-Phe | Thr-Lys-Pro-Asn-Pro-Phe | 2268 |
| Thr-Lys-Pro-Asn-Lys-Phe | Thr-Lys-Pro-Asn-Lys-Phe | Thr-Lys-Pro-Asn-Lys-Phe | 2269 |
| Thr-Lys-Pro-Tyr-Phe | Thr-Lys-Pro-Tyr-Phe | Thr-Lys-Pro-Tyr-Phe | 2270 |
| Thr-Lys-Pro-Tyr-Arg-Phe | Thr-Lys-Pro-Tyr-Arg-Phe | Thr-Lys-Pro-Tyr-Arg-Phe | 2271 |
| Thr-Lys-Pro-Tyr-Phe-Phe | Thr-Lys-Pro-Tyr-Phe-Phe | Thr-Lys-Pro-Tyr-Phe-Phe | 2272 |
| Thr-Lys-Pro-Tyr-Tyr-Phe | Thr-Lys-Pro-Tyr-Tyr-Phe | Thr-Lys-Pro-Tyr-Tyr-Phe | 2273 |
| Thr-Lys-Pro-Tyr-His-Phe | Thr-Lys-Pro-Tyr-His-Phe | Thr-Lys-Pro-Tyr-His-Phe | 2274 |
| Thr-Lys-Pro-Tyr-Pro-Phe | Thr-Lys-Pro-Tyr-Pro-Phe | Thr-Lys-Pro-Tyr-Pro-Phe | 2275 |
| Thr-Lys-Pro-Tyr-Lys-Phe | Thr-Lys-Pro-Tyr-Lys-Phe | Thr-Lys-Pro-Tyr-Lys-Phe | 2276 |
| Thr-Lys-Pro-Arg-Phe | Thr-Lys-Pro-Arg-Phe | Thr-Lys-Pro-Arg-Phe | 2277 |
| Thr-Lys-Pro-Arg-Arg-Phe | Thr-Lys-Pro-Arg-Arg-Phe | Thr-Lys-Pro-Arg-Arg-Phe | 2278 |
| Thr-Lys-Pro-Arg-Phe-Phe | Thr-Lys-Pro-Arg-Phe-Phe | Thr-Lys-Pro-Arg-Phe-Phe | 2279 |
| Thr-Lys-Pro-Arg-Tyr-Phe | Thr-Lys-Pro-Arg-Tyr-Phe | Thr-Lys-Pro-Arg-Tyr-Phe | 2280 |
| Thr-Lys-Pro-Arg-His-Phe | Thr-Lys-Pro-Arg-His-Phe | Thr-Lys-Pro-Arg-His-Phe | 2281 |

TABLE 1-continued

| X-OH | X-OCH₃ | X-NH₂ | SEQ ID NO |
|---|---|---|---|
| Thr-Lys-Pro-Arg-Pro-Phe | Thr-Lys-Pro-Arg-Pro-Phe | Thr-Lys-Pro-Arg-Pro-Phe | 7 |
| Thr-Lys-Pro-Arg-Lys-Phe | Thr-Lys-Pro-Arg-Lys-Phe | Thr-Lys-Pro-Arg-Lys-Phe | 2282 |
| Met-Thr-Lys-Pro-Phe | Met-Thr-Lys-Pro-Phe | Met-Thr-Lys-Pro-Phe | 2283 |
| Met-Thr-Lys-Pro-Arg-Phe | Met-Thr-Lys-Pro-Arg-Phe | Met-Thr-Lys-Pro-Arg-Phe | 2284 |
| Met-Thr-Lys-Pro-Phe-Phe | Met-Thr-Lys-Pro-Phe-Phe | Met-Thr-Lys-Pro-Phe-Phe | 2285 |
| Met-Thr-Lys-Pro-Tyr-Phe | Met-Thr-Lys-Pro-Tyr-Phe | Met-Thr-Lys-Pro-Tyr-Phe | 2286 |
| Met-Thr-Lys-Pro-Gly-Phe | Met-Thr-Lys-Pro-Gly-Phe | Met-Thr-Lys-Pro-Gly-Phe | 2287 |
| Met-Thr-Lys-Pro-His-Phe | Met-Thr-Lys-Pro-His-Phe | Met-Thr-Lys-Pro-His-Phe | 2288 |
| Met-Thr-Lys-Pro-Lys-Phe | Met-Thr-Lys-Pro-Lys-Phe | Met-Thr-Lys-Pro-Lys-Phe | 2289 |
| Met-Thr-Lys-Pro-Gly-Phe | Met-Thr-Lys-Pro-Gly-Phe | Met-Thr-Lys-Pro-Gly-Phe | 2290 |
| Met-Thr-Lys-Pro-Gly-Arg-Phe | Met-Thr-Lys-Pro-Gly-Arg-Phe | Met-Thr-Lys-Pro-Gly-Arg-Phe | 2291 |
| Met-Thr-Lys-Pro-Gly-Phe-Phe | Met-Thr-Lys-Pro-Gly-Phe-Phe | Met-Thr-Lys-Pro-Gly-Phe-Phe | 2292 |
| Met-Thr-Lys-Pro-Gly-Tyr-Phe | Met-Thr-Lys-Pro-Gly-Tyr-Phe | Met-Thr-Lys-Pro-Gly-Tyr-Phe | 2293 |
| Met-Thr-Lys-Pro-Gly-His-Phe | Met-Thr-Lys-Pro-Gly-His-Phe | Met-Thr-Lys-Pro-Gly-His-Phe | 2294 |
| Met-Thr-Lys-Pro-Gly-Pro-Phe | Met-Thr-Lys-Pro-Gly-Pro-Phe | Met-Thr-Lys-Pro-Gly-Pro-Phe | 2295 |
| Met-Thr-Lys-Pro-Gly-Lys-Phe | Met-Thr-Lys-Pro-Gly-Lys-Phe | Met-Thr-Lys-Pro-Gly-Lys-Phe | 2296 |
| Met-Thr-Lys-Pro-Asp-Phe | Met-Thr-Lys-Pro-Asp-Phe | Met-Thr-Lys-Pro-Asp-Phe | 2297 |
| Met-Thr-Lys-Pro-Asp-Arg-Phe | Met-Thr-Lys-Pro-Asp-Arg-Phe | Met-Thr-Lys-Pro-Asp-Arg-Phe | 2298 |
| Met-Thr-Lys-Pro-Asp-Phe-Phe | Met-Thr-Lys-Pro-Asp-Phe-Phe | Met-Thr-Lys-Pro-Asp-Phe-Phe | 2299 |
| Met-Thr-Lys-Pro-Asp-Tyr-Phe | Met-Thr-Lys-Pro-Asp-Tyr-Phe | Met-Thr-Lys-Pro-Asp-Tyr-Phe | 2300 |
| Met-Thr-Lys-Pro-Asp-His-Phe | Met-Thr-Lys-Pro-Asp-His-Phe | Met-Thr-Lys-Pro-Asp-His-Phe | 2301 |
| Met-Thr-Lys-Pro-Asp-Pro-Phe | Met-Thr-Lys-Pro-Asp-Pro-Phe | Met-Thr-Lys-Pro-Asp-Pro-Phe | 2302 |
| Met-Thr-Lys-Pro-Asp-Lys-Phe | Met-Thr-Lys-Pro-Asp-Lys-Phe | Met-Thr-Lys-Pro-Asp-Lys-Phe | 2303 |
| Met-Thr-Lys-Pro-Trp-Phe | Met-Thr-Lys-Pro-Trp-Phe | Met-Thr-Lys-Pro-Trp-Phe | 2304 |
| Met-Thr-Lys-Pro-Trp-Arg-Phe | Met-Thr-Lys-Pro-Trp-Arg-Phe | Met-Thr-Lys-Pro-Trp-Arg-Phe | 2305 |
| Met-Thr-Lys-Pro-Trp-Phe-Phe | Met-Thr-Lys-Pro-Trp-Phe-Phe | Met-Thr-Lys-Pro-Trp-Phe-Phe | 2306 |
| Met-Thr-Lys-Pro-Trp-Tyr-Phe | Met-Thr-Lys-Pro-Trp-Tyr-Phe | Met-Thr-Lys-Pro-Trp-Tyr-Phe | 2307 |
| Met-Thr-Lys-Pro-Trp-His-Phe | Met-Thr-Lys-Pro-Trp-His-Phe | Met-Thr-Lys-Pro-Trp-His-Phe | 2308 |
| Met-Thr-Lys-Pro-Trp-Pro-Phe | Met-Thr-Lys-Pro-Trp-Pro-Phe | Met-Thr-Lys-Pro-Trp-Pro-Phe | 2309 |
| Met-Thr-Lys-Pro-Trp-Lys-Phe | Met-Thr-Lys-Pro-Trp-Lys-Phe | Met-Thr-Lys-Pro-Trp-Lys-Phe | 2310 |
| Met-Thr-Lys-Pro-Gln-Phe | Met-Thr-Lys-Pro-Gln-Phe | Met-Thr-Lys-Pro-Gln-Phe | 2311 |
| Met-Thr-Lys-Pro-Gln-Arg-Phe | Met-Thr-Lys-Pro-Gln-Arg-Phe | Met-Thr-Lys-Pro-Gln-Arg-Phe | 2312 |
| Met-Thr-Lys-Pro-Gln-Phe-Phe | Met-Thr-Lys-Pro-Gln-Phe-Phe | Met-Thr-Lys-Pro-Gln-Phe-Phe | 2313 |
| Met-Thr-Lys-Pro-Gln-Tyr-Phe | Met-Thr-Lys-Pro-Gln-Tyr-Phe | Met-Thr-Lys-Pro-Gln-Tyr-Phe | 2314 |
| Met-Thr-Lys-Pro-Gln-His-Phe | Met-Thr-Lys-Pro-Gln-His-Phe | Met-Thr-Lys-Pro-Gln-His-Phe | 2315 |
| Met-Thr-Lys-Pro-Gln-Pro-Phe | Met-Thr-Lys-Pro-Gln-Pro-Phe | Met-Thr-Lys-Pro-Gln-Pro-Phe | 2316 |
| Met-Thr-Lys-Pro-Gln-Lys-Phe | Met-Thr-Lys-Pro-Gln-Lys-Phe | Met-Thr-Lys-Pro-Gln-Lys-Phe | 2317 |
| Met-Thr-Lys-Pro-Asn-Phe | Met-Thr-Lys-Pro-Asn-Phe | Met-Thr-Lys-Pro-Asn-Phe | 2318 |

TABLE 1-continued

| X-OH | X-OCH₃ | X-NH₂ | SEQ ID NO |
|---|---|---|---|
| Met-Thr-Lys-Pro-Asn-Arg-Phe | Met-Thr-Lys-Pro-Asn-Arg-Phe | Met-Thr-Lys-Pro-Asn-Arg-Phe | 2319 |
| Met-Thr-Lys-Pro-Asn-Phe-Phe | Met-Thr-Lys-Pro-Asn-Phe-Phe | Met-Thr-Lys-Pro-Asn-Phe-Phe | 2320 |
| Met-Thr-Lys-Pro-Asn-Tyr-Phe | Met-Thr-Lys-Pro-Asn-Tyr-Phe | Met-Thr-Lys-Pro-Asn-Tyr-Phe | 2321 |
| Met-Thr-Lys-Pro-Asn-His-Phe | Met-Thr-Lys-Pro-Asn-His-Phe | Met-Thr-Lys-Pro-Asn-His-Phe | 2322 |
| Met-Thr-Lys-Pro-Asn-Pro-Phe | Met-Thr-Lys-Pro-Asn-Pro-Phe | Met-Thr-Lys-Pro-Asn-Pro-Phe | 2323 |
| Met-Thr-Lys-Pro-Asn-Lys-Phe | Met-Thr-Lys-Pro-Asn-Lys-Phe | Met-Thr-Lys-Pro-Asn-Lys-Phe | 2324 |
| Met-Thr-Lys-Pro-Tyr-Phe | Met-Thr-Lys-Pro-Tyr-Phe | Met-Thr-Lys-Pro-Tyr-Phe | 2325 |
| Met-Thr-Lys-Pro-Tyr-Arg-Phe | Met-Thr-Lys-Pro-Tyr-Arg-Phe | Met-Thr-Lys-Pro-Tyr-Arg-Phe | 2326 |
| Met-Thr-Lys-Pro-Tyr-Phe-Phe | Met-Thr-Lys-Pro-Tyr-Phe-Phe | Met-Thr-Lys-Pro-Tyr-Phe-Phe | 2327 |
| Met-Thr-Lys-Pro-Tyr-Tyr-Phe | Met-Thr-Lys-Pro-Tyr-Tyr-Phe | Met-Thr-Lys-Pro-Tyr-Tyr-Phe | 2328 |
| Met-Thr-Lys-Pro-Tyr-His-Phe | Met-Thr-Lys-Pro-Tyr-His-Phe | Met-Thr-Lys-Pro-Tyr-His-Phe | 2329 |
| Met-Thr-Lys-Pro-Tyr-Pro-Phe | Met-Thr-Lys-Pro-Tyr-Pro-Phe | Met-Thr-Lys-Pro-Tyr-Pro-Phe | 2330 |
| Met-Thr-Lys-Pro-Tyr-Lys-Phe | Met-Thr-Lys-Pro-Tyr-Lys-Phe | Met-Thr-Lys-Pro-Tyr-Lys-Phe | 2331 |
| Met-Thr-Lys-Pro-Arg-Phe | Met-Thr-Lys-Pro-Arg-Phe | Met-Thr-Lys-Pro-Arg-Phe | 2332 |
| Met-Thr-Lys-Pro-Arg-Arg-Phe | Met-Thr-Lys-Pro-Arg-Arg-Phe | Met-Thr-Lys-Pro-Arg-Arg-Phe | 2333 |
| Met-Thr-Lys-Pro-Arg-Phe-Phe | Met-Thr-Lys-Pro-Arg-Phe-Phe | Met-Thr-Lys-Pro-Arg-Phe-Phe | 2334 |
| Met-Thr-Lys-Pro-Arg-Tyr-Phe | Met-Thr-Lys-Pro-Arg-Tyr-Phe | Met-Thr-Lys-Pro-Arg-Tyr-Phe | 2335 |
| Met-Thr-Lys-Pro-Arg-His-Phe | Met-Thr-Lys-Pro-Arg-His-Phe | Met-Thr-Lys-Pro-Arg-His-Phe | 2336 |
| Met-Thr-Lys-Pro-Arg-Pro-Phe | Met-Thr-Lys-Pro-Arg-Pro-Phe | Met-Thr-Lys-Pro-Arg-Pro-Phe | 2337 |
| Met-Thr-Lys-Pro-Arg-Lys-Phe | Met-Thr-Lys-Pro-Arg-Lys-Phe | Met-Thr-Lys-Pro-Arg-Lys-Phe | 2338 |
| Met(O)-Thr-Lys-Pro-Phe | Met(O)-Thr-Lys-Pro-Phe | Met(O)-Thr-Lys-Pro-Phe | 2339 |
| Met(O)-Thr-Lys-Pro-Arg-Phe | Met(O)-Thr-Lys-Pro-Arg-Phe | Met(O)-Thr-Lys-Pro-Arg-Phe | 2340 |
| Met(O)-Thr-Lys-Pro-Phe-Phe | Met(O)-Thr-Lys-Pro-Phe-Phe | Met(O)-Thr-Lys-Pro-Phe-Phe | 2341 |
| Met(O)-Thr-Lys-Pro-Tyr-Phe | Met(O)-Thr-Lys-Pro-Tyr-Phe | Met(O)-Thr-Lys-Pro-Tyr-Phe | 2342 |
| Met(O)-Thr-Lys-Pro-Gly-Phe | Met(O)-Thr-Lys-Pro-Gly-Phe | Met(O)-Thr-Lys-Pro-Gly-Phe | 2343 |
| Met(O)-Thr-Lys-Pro-His-Phe | Met(O)-Thr-Lys-Pro-His-Phe | Met(O)-Thr-Lys-Pro-His-Phe | 2344 |
| Met(O)-Thr-Lys-Pro-Lys-Phe | Met(O)-Thr-Lys-Pro-Lys-Phe | Met(O)-Thr-Lys-Pro-Lys-Phe | 2345 |
| Met(O)-Thr-Lys-Pro-Gly-Phe | Met(O)-Thr-Lys-Pro-Gly-Phe | Met(O)-Thr-Lys-Pro-Gly-Phe | 2346 |
| Met(O)-Thr-Lys-Pro-Gly-Arg-Phe | Met(O)-Thr-Lys-Pro-Gly-Arg-Phe | Met(O)-Thr-Lys-Pro-Gly-Arg-Phe | 2347 |
| Met(O)-Thr-Lys-Pro-Gly-Phe-Phe | Met(O)-Thr-Lys-Pro-Gly-Phe-Phe | Met(O)-Thr-Lys-Pro-Gly-Phe-Phe | 2348 |
| Met(O)-Thr-Lys-Pro-Gly-Tyr-Phe | Met(O)-Thr-Lys-Pro-Gly-Tyr-Phe | Met(O)-Thr-Lys-Pro-Gly-Tyr-Phe | 2349 |
| Met(O)-Thr-Lys-Pro-Gly-His-Phe | Met(O)-Thr-Lys-Pro-Gly-His-Phe | Met(O)-Thr-Lys-Pro-Gly-His-Phe | 2350 |
| Met(O)-Thr-Lys-Pro-Gly-Pro-Phe | Met(O)-Thr-Lys-Pro-Gly-Pro-Phe | Met(O)-Thr-Lys-Pro-Gly-Pro-Phe | 2351 |
| Met(O)-Thr-Lys-Pro-Gly-Lys-Phe | Met(O)-Thr-Lys-Pro-Gly-Lys-Phe | Met(O)-Thr-Lys-Pro-Gly-Lys-Phe | 2352 |
| Met(O)-Thr-Lys-Pro-Asp-Phe | Met(O)-Thr-Lys-Pro-Asp-Phe | Met(O)-Thr-Lys-Pro-Asp-Phe | 2353 |

TABLE 1-continued

| X-OH | X-OCH₃ | X-NH₂ | SEQ ID NO |
|---|---|---|---|
| Met(O)-Thr-Lys-Pro-Asp-Arg-Phe | Met(O)-Thr-Lys-Pro-Asp-Arg-Phe | Met(O)-Thr-Lys-Pro-Asp-Arg-Phe | 2354 |
| Met(O)-Thr-Lys-Pro-Asp-Phe-Phe | Met(O)-Thr-Lys-Pro-Asp-Phe-Phe | Met(O)-Thr-Lys-Pro-Asp-Phe-Phe | 2355 |
| Met(O)-Thr-Lys-Pro-Asp-Tyr-Phe | Met(O)-Thr-Lys-Pro-Asp-Tyr-Phe | Met(O)-Thr-Lys-Pro-Asp-Tyr-Phe | 2356 |
| Met(O)-Thr-Lys-Pro-Asp-His-Phe | Met(O)-Thr-Lys-Pro-Asp-His-Phe | Met(O)-Thr-Lys-Pro-Asp-His-Phe | 2357 |
| Met(O)-Thr-Lys-Pro-Asp-Pro-Phe | Met(O)-Thr-Lys-Pro-Asp-Pro-Phe | Met(O)-Thr-Lys-Pro-Asp-Pro-Phe | 2358 |
| Met(O)-Thr-Lys-Pro-Asp-Lys-Phe | Met(O)-Thr-Lys-Pro-Asp-Lys-Phe | Met(O)-Thr-Lys-Pro-Asp-Lys-Phe | 2359 |
| Met(O)-Thr-Lys-Pro-Trp-Phe | Met(O)-Thr-Lys-Pro-Trp-Phe | Met(O)-Thr-Lys-Pro-Trp-Phe | 2360 |
| Met(O)-Thr-Lys-Pro-Trp-Arg-Phe | Met(O)-Thr-Lys-Pro-Trp-Arg-Phe | Met(O)-Thr-Lys-Pro-Trp-Arg-Phe | 2361 |
| Met(O)-Thr-Lys-Pro-Trp-Phe-Phe | Met(O)-Thr-Lys-Pro-Trp-Phe-Phe | Met(O)-Thr-Lys-Pro-Trp-Phe-Phe | 2362 |
| Met(O)-Thr-Lys-Pro-Trp-Tyr-Phe | Met(O)-Thr-Lys-Pro-Trp-Tyr-Phe | Met(O)-Thr-Lys-Pro-Trp-Tyr-Phe | 2363 |
| Met(O)-Thr-Lys-Pro-Trp-His-Phe | Met(O)-Thr-Lys-Pro-Trp-His-Phe | Met(O)-Thr-Lys-Pro-Trp-His-Phe | 2364 |
| Met(O)-Thr-Lys-Pro-Trp-Pro-Phe | Met(O)-Thr-Lys-Pro-Trp-Pro-Phe | Met(O)-Thr-Lys-Pro-Trp-Pro-Phe | 2365 |
| Met(O)-Thr-Lys-Pro-Trp-Lys-Phe | Met(O)-Thr-Lys-Pro-Trp-Lys-Phe | Met(O)-Thr-Lys-Pro-Trp-Lys-Phe | 2366 |
| Met(O)-Thr-Lys-Pro-Gln-Phe | Met(O)-Thr-Lys-Pro-Gln-Phe | Met(O)-Thr-Lys-Pro-Gln-Phe | 2367 |
| Met(O)-Thr-Lys-Pro-Gln-Arg-Phe | Met(O)-Thr-Lys-Pro-Gln-Arg-Phe | Met(O)-Thr-Lys-Pro-Gln-Arg-Phe | 2368 |
| Met(O)-Thr-Lys-Pro-Gln-Phe-Phe | Met(O)-Thr-Lys-Pro-Gln-Phe-Phe | Met(O)-Thr-Lys-Pro-Gln-Phe-Phe | 2369 |
| Met(O)-Thr-Lys-Pro-Gln-Tyr-Phe | Met(O)-Thr-Lys-Pro-Gln-Tyr-Phe | Met(O)-Thr-Lys-Pro-Gln-Tyr-Phe | 2370 |
| Met(O)-Thr-Lys-Pro-Gln-His-Phe | Met(O)-Thr-Lys-Pro-Gln-His-Phe | Met(O)-Thr-Lys-Pro-Gln-His-Phe | 2371 |
| Met(O)-Thr-Lys-Pro-Gln-Pro-Phe | Met(O)-Thr-Lys-Pro-Gln-Pro-Phe | Met(O)-Thr-Lys-Pro-Gln-Pro-Phe | 2372 |
| Met(O)-Thr-Lys-Pro-Gln-Lys-Phe | Met(O)-Thr-Lys-Pro-Gln-Lys-Phe | Met(O)-Thr-Lys-Pro-Gln-Lys-Phe | 2373 |
| Met(O)-Thr-Lys-Pro-Asn-Phe | Met(O)-Thr-Lys-Pro-Asn-Phe | Met(O)-Thr-Lys-Pro-Asn-Phe | 2374 |
| Met(O)-Thr-Lys-Pro-Asn-Arg-Phe | Met(O)-Thr-Lys-Pro-Asn-Arg-Phe | Met(O)-Thr-Lys-Pro-Asn-Arg-Phe | 2375 |
| Met(O)-Thr-Lys-Pro-Asn-Phe-Phe | Met(O)-Thr-Lys-Pro-Asn-Phe-Phe | Met(O)-Thr-Lys-Pro-Asn-Phe-Phe | 2376 |
| Met(O)-Thr-Lys-Pro-Asn-Tyr-Phe | Met(O)-Thr-Lys-Pro-Asn-Tyr-Phe | Met(O)-Thr-Lys-Pro-Asn-Tyr-Phe | 2377 |
| Met(O)-Thr-Lys-Pro-Asn-His-Phe | Met(O)-Thr-Lys-Pro-Asn-His-Phe | Met(O)-Thr-Lys-Pro-Asn-His-Phe | 2378 |
| Met(O)-Thr-Lys-Pro-Asn-Pro-Phe | Met(O)-Thr-Lys-Pro-Asn-Pro-Phe | Met(O)-Thr-Lys-Pro-Asn-Pro-Phe | 2379 |

TABLE 1-continued

| X-OH | X-OCH₃ | X-NH₂ | SEQ ID NO |
|---|---|---|---|
| Met(O)-Thr-Lys-Pro-Asn-Lys-Phe | Met(O)-Thr-Lys-Pro-Asn-Lys-Phe | Met(O)-Thr-Lys-Pro-Asn-Lys-Phe | 2380 |
| Met(O)-Thr-Lys-Pro-Tyr-Phe | Met(O)-Thr-Lys-Pro-Tyr-Phe | Met(O)-Thr-Lys-Pro-Tyr-Phe | 2381 |
| Met(O)-Thr-Lys-Pro-Tyr-Arg-Phe | Met(O)-Thr-Lys-Pro-Tyr-Arg-Phe | Met(O)-Thr-Lys-Pro-Tyr-Arg-Phe | 2382 |
| Met(O)-Thr-Lys-Pro-Tyr-Phe-Phe | Met(O)-Thr-Lys-Pro-Tyr-Phe-Phe | Met(O)-Thr-Lys-Pro-Tyr-Phe-Phe | 2383 |
| Met(O)-Thr-Lys-Pro-Tyr-Tyr-Phe | Met(O)-Thr-Lys-Pro-Tyr-Tyr-Phe | Met(O)-Thr-Lys-Pro-Tyr-Tyr-Phe | 2384 |
| Met(O)-Thr-Lys-Pro-Tyr-His-Phe | Met(O)-Thr-Lys-Pro-Tyr-His-Phe | Met(O)-Thr-Lys-Pro-Tyr-His-Phe | 2385 |
| Met(O)-Thr-Lys-Pro-Tyr-Pro-Phe | Met(O)-Thr-Lys-Pro-Tyr-Pro-Phe | Met(O)-Thr-Lys-Pro-Tyr-Pro-Phe | 2386 |
| Met(O)-Thr-Lys-Pro-Tyr-Lys-Phe | Met(O)-Thr-Lys-Pro-Tyr-Lys-Phe | Met(O)-Thr-Lys-Pro-Tyr-Lys-Phe | 2387 |
| Met(O)-Thr-Lys-Pro-Arg-Phe | Met(O)-Thr-Lys-Pro-Arg-Phe | Met(O)-Thr-Lys-Pro-Arg-Phe | 2388 |
| Met(O)-Thr-Lys-Pro-Arg-Arg-Phe | Met(O)-Thr-Lys-Pro-Arg-Arg-Phe | Met(O)-Thr-Lys-Pro-Arg-Arg-Phe | 2389 |
| Met(O)-Thr-Lys-Pro-Arg-Phe-Phe | Met(O)-Thr-Lys-Pro-Arg-Phe-Phe | Met(O)-Thr-Lys-Pro-Arg-Phe-Phe | 2390 |
| Met(O)-Thr-Lys-Pro-Arg-Tyr-Phe | Met(O)-Thr-Lys-Pro-Arg-Tyr-Phe | Met(O)-Thr-Lys-Pro-Arg-Tyr-Phe | 2391 |
| Met(O)-Thr-Lys-Pro-Arg-His-Phe | Met(O)-Thr-Lys-Pro-Arg-His-Phe | Met(O)-Thr-Lys-Pro-Arg-His-Phe | 2392 |
| Met(O)-Thr-Lys-Pro-Arg-Pro-Phe | Met(O)-Thr-Lys-Pro-Arg-Pro-Phe | Met(O)-Thr-Lys-Pro-Arg-Pro-Phe | 2393 |
| Met(O)-Thr-Lys-Pro-Arg-Lys-Phe | Met(O)-Thr-Lys-Pro-Arg-Lys-Phe | Met(O)-Thr-Lys-Pro-Arg-Lys-Phe | 2394 |
| Thr-Thr-Lys-Pro-Phe | Thr-Thr-Lys-Pro-Phe | Thr-Thr-Lys-Pro-Phe | 2395 |
| Thr-Thr-Lys-Pro-Arg-Phe | Thr-Thr-Lys-Pro-Arg-Phe | Thr-Thr-Lys-Pro-Arg-Phe | 2396 |
| Thr-Thr-Lys-Pro-Phe-Phe | Thr-Thr-Lys-Pro-Phe-Phe | Thr-Thr-Lys-Pro-Phe-Phe | 2397 |
| Thr-Thr-Lys-Pro-Tyr-Phe | Thr-Thr-Lys-Pro-Tyr-Phe | Thr-Thr-Lys-Pro-Tyr-Phe | 2398 |
| Thr-Thr-Lys-Pro-Gly-Phe | Thr-Thr-Lys-Pro-Gly-Phe | Thr-Thr-Lys-Pro-Gly-Phe | 2399 |
| Thr-Thr-Lys-Pro-His-Phe | Thr-Thr-Lys-Pro-His-Phe | Thr-Thr-Lys-Pro-His-Phe | 2400 |
| Thr-Thr-Lys-Pro-Lys-Phe | Thr-Thr-Lys-Pro-Lys-Phe | Thr-Thr-Lys-Pro-Lys-Phe | 2401 |
| Thr-Thr-Lys-Pro-Gly-Phe | Thr-Thr-Lys-Pro-Gly-Phe | Thr-Thr-Lys-Pro-Gly-Phe | 2402 |
| Thr-Thr-Lys-Pro-Gly-Arg-Phe | Thr-Thr-Lys-Pro-Gly-Arg-Phe | Thr-Thr-Lys-Pro-Gly-Arg-Phe | 2403 |
| Thr-Thr-Lys-Pro-Gly-Phe-Phe | Thr-Thr-Lys-Pro-Gly-Phe-Phe | Thr-Thr-Lys-Pro-Gly-Phe-Phe | 2404 |
| Thr-Thr-Lys-Pro-Gly-Tyr-Phe | Thr-Thr-Lys-Pro-Gly-Tyr-Phe | Thr-Thr-Lys-Pro-Gly-Tyr-Phe | 2405 |
| Thr-Thr-Lys-Pro-Gly-His-Phe | Thr-Thr-Lys-Pro-Gly-His-Phe | Thr-Thr-Lys-Pro-Gly-His-Phe | 2406 |
| Thr-Thr-Lys-Pro-Gly-Pro-Phe | Thr-Thr-Lys-Pro-Gly-Pro-Phe | Thr-Thr-Lys-Pro-Gly-Pro-Phe | 2407 |
| Thr-Thr-Lys-Pro-Gly-Lys-Phe | Thr-Thr-Lys-Pro-Gly-Lys-Phe | Thr-Thr-Lys-Pro-Gly-Lys-Phe | 2408 |
| Thr-Thr-Lys-Pro-Asp-Phe | Thr-Thr-Lys-Pro-Asp-Phe | Thr-Thr-Lys-Pro-Asp-Phe | 2409 |
| Thr-Thr-Lys-Pro-Asp-Arg-Phe | Thr-Thr-Lys-Pro-Asp-Arg-Phe | Thr-Thr-Lys-Pro-Asp-Arg-Phe | 2410 |
| Thr-Thr-Lys-Pro-Asp-Phe-Phe | Thr-Thr-Lys-Pro-Asp-Phe-Phe | Thr-Thr-Lys-Pro-Asp-Phe-Phe | 2411 |

TABLE 1-continued

| X-OH | X-OCH₃ | X-NH₂ | SEQ ID NO |
|---|---|---|---|
| Thr-Thr-Lys-Pro-Asp-Tyr-Phe | Thr-Thr-Lys-Pro-Asp-Tyr-Phe | Thr-Thr-Lys-Pro-Asp-Tyr-Phe | 2412 |
| Thr-Thr-Lys-Pro-Asp-His-Phe | Thr-Thr-Lys-Pro-Asp-His-Phe | Thr-Thr-Lys-Pro-Asp-His-Phe | 2413 |
| Thr-Thr-Lys-Pro-Asp-Pro-Phe | Thr-Thr-Lys-Pro-Asp-Pro-Phe | Thr-Thr-Lys-Pro-Asp-Pro-Phe | 2414 |
| Thr-Thr-Lys-Pro-Asp-Lys-Phe | Thr-Thr-Lys-Pro-Asp-Lys-Phe | Thr-Thr-Lys-Pro-Asp-Lys-Phe | 2415 |
| Thr-Thr-Lys-Pro-Trp-Phe | Thr-Thr-Lys-Pro-Trp-Phe | Thr-Thr-Lys-Pro-Trp-Phe | 2416 |
| Thr-Thr-Lys-Pro-Trp-Arg-Phe | Thr-Thr-Lys-Pro-Trp-Arg-Phe | Thr-Thr-Lys-Pro-Trp-Arg-Phe | 2417 |
| Thr-Thr-Lys-Pro-Trp-Phe-Phe | Thr-Thr-Lys-Pro-Trp-Phe-Phe | Thr-Thr-Lys-Pro-Trp-Phe-Phe | 2418 |
| Thr-Thr-Lys-Pro-Trp-Tyr-Phe | Thr-Thr-Lys-Pro-Trp-Tyr-Phe | Thr-Thr-Lys-Pro-Trp-Tyr-Phe | 2419 |
| Thr-Thr-Lys-Pro-Trp-His-Phe | Thr-Thr-Lys-Pro-Trp-His-Phe | Thr-Thr-Lys-Pro-Trp-His-Phe | 2420 |
| Thr-Thr-Lys-Pro-Trp-Pro-Phe | Thr-Thr-Lys-Pro-Trp-Pro-Phe | Thr-Thr-Lys-Pro-Trp-Pro-Phe | 2421 |
| Thr-Thr-Lys-Pro-Trp-Lys-Phe | Thr-Thr-Lys-Pro-Trp-Lys-Phe | Thr-Thr-Lys-Pro-Trp-Lys-Phe | 2422 |
| Thr-Thr-Lys-Pro-Gln-Phe | Thr-Thr-Lys-Pro-Gln-Phe | Thr-Thr-Lys-Pro-Gln-Phe | 2423 |
| Thr-Thr-Lys-Pro-Gln-Arg-Phe | Thr-Thr-Lys-Pro-Gln-Arg-Phe | Thr-Thr-Lys-Pro-Gln-Arg-Phe | 2424 |
| Thr-Thr-Lys-Pro-Gln-Phe-Phe | Thr-Thr-Lys-Pro-Gln-Phe-Phe | Thr-Thr-Lys-Pro-Gln-Phe-Phe | 2425 |
| Thr-Thr-Lys-Pro-Gln-Tyr-Phe | Thr-Thr-Lys-Pro-Gln-Tyr-Phe | Thr-Thr-Lys-Pro-Gln-Tyr-Phe | 2426 |
| Thr-Thr-Lys-Pro-Gln-His-Phe | Thr-Thr-Lys-Pro-Gln-His-Phe | Thr-Thr-Lys-Pro-Gln-His-Phe | 2427 |
| Thr-Thr-Lys-Pro-Gln-Pro-Phe | Thr-Thr-Lys-Pro-Gln-Pro-Phe | Thr-Thr-Lys-Pro-Gln-Pro-Phe | 2428 |
| Thr-Thr-Lys-Pro-Gln-Lys-Phe | Thr-Thr-Lys-Pro-Gln-Lys-Phe | Thr-Thr-Lys-Pro-Gln-Lys-Phe | 2429 |
| Thr-Thr-Lys-Pro-Asn-Phe | Thr-Thr-Lys-Pro-Asn-Phe | Thr-Thr-Lys-Pro-Asn-Phe | 2430 |
| Thr-Thr-Lys-Pro-Asn-Arg-Phe | Thr-Thr-Lys-Pro-Asn-Arg-Phe | Thr-Thr-Lys-Pro-Asn-Arg-Phe | 2431 |
| Thr-Thr-Lys-Pro-Asn-Phe-Phe | Thr-Thr-Lys-Pro-Asn-Phe-Phe | Thr-Thr-Lys-Pro-Asn-Phe-Phe | 2432 |
| Thr-Thr-Lys-Pro-Asn-Tyr-Phe | Thr-Thr-Lys-Pro-Asn-Tyr-Phe | Thr-Thr-Lys-Pro-Asn-Tyr-Phe | 2433 |
| Thr-Thr-Lys-Pro-Asn-His-Phe | Thr-Thr-Lys-Pro-Asn-His-Phe | Thr-Thr-Lys-Pro-Asn-His-Phe | 2434 |
| Thr-Thr-Lys-Pro-Asn-Pro-Phe | Thr-Thr-Lys-Pro-Asn-Pro-Phe | Thr-Thr-Lys-Pro-Asn-Pro-Phe | 2435 |
| Thr-Thr-Lys-Pro-Asn-Lys-Phe | Thr-Thr-Lys-Pro-Asn-Lys-Phe | Thr-Thr-Lys-Pro-Asn-Lys-Phe | 2436 |
| Thr-Thr-Lys-Pro-Tyr-Phe | Thr-Thr-Lys-Pro-Tyr-Phe | Thr-Thr-Lys-Pro-Tyr-Phe | 2437 |
| Thr-Thr-Lys-Pro-Tyr-Arg-Phe | Thr-Thr-Lys-Pro-Tyr-Arg-Phe | Thr-Thr-Lys-Pro-Tyr-Arg-Phe | 2438 |
| Thr-Thr-Lys-Pro-Tyr-Phe-Phe | Thr-Thr-Lys-Pro-Tyr-Phe-Phe | Thr-Thr-Lys-Pro-Tyr-Phe-Phe | 2439 |
| Thr-Thr-Lys-Pro-Tyr-Tyr-Phe | Thr-Thr-Lys-Pro-Tyr-Tyr-Phe | Thr-Thr-Lys-Pro-Tyr-Tyr-Phe | 2440 |
| Thr-Thr-Lys-Pro-Tyr-His-Phe | Thr-Thr-Lys-Pro-Tyr-His-Phe | Thr-Thr-Lys-Pro-Tyr-His-Phe | 2441 |
| Thr-Thr-Lys-Pro-Tyr-Pro-Phe | Thr-Thr-Lys-Pro-Tyr-Pro-Phe | Thr-Thr-Lys-Pro-Tyr-Pro-Phe | 2442 |
| Thr-Thr-Lys-Pro-Tyr-Lys-Phe | Thr-Thr-Lys-Pro-Tyr-Lys-Phe | Thr-Thr-Lys-Pro-Tyr-Lys-Phe | 2443 |
| Thr-Thr-Lys-Pro-Arg-Phe | Thr-Thr-Lys-Pro-Arg-Phe | Thr-Thr-Lys-Pro-Arg-Phe | 2444 |
| Thr-Thr-Lys-Pro-Arg-Arg-Phe | Thr-Thr-Lys-Pro-Arg-Arg-Phe | Thr-Thr-Lys-Pro-Arg-Arg-Phe | 2445 |
| Thr-Thr-Lys-Pro-Arg-Phe-Phe | Thr-Thr-Lys-Pro-Arg-Phe-Phe | Thr-Thr-Lys-Pro-Arg-Phe-Phe | 2446 |
| Thr-Thr-Lys-Pro-Arg-Tyr-Phe | Thr-Thr-Lys-Pro-Arg-Tyr-Phe | Thr-Thr-Lys-Pro-Arg-Tyr-Phe | 2447 |
| Thr-Thr-Lys-Pro-Arg-His-Phe | Thr-Thr-Lys-Pro-Arg-His-Phe | Thr-Thr-Lys-Pro-Arg-His-Phe | 2448 |
| Thr-Thr-Lys-Pro-Arg-Pro-Phe | Thr-Thr-Lys-Pro-Arg-Pro-Phe | Thr-Thr-Lys-Pro-Arg-Pro-Phe | 2449 |

TABLE 1-continued

| X-OH | X-OCH₃ | X-NH₂ | SEQ ID NO |
|---|---|---|---|
| Thr-Thr-Lys-Pro-Arg-Lys-Phe | Thr-Thr-Lys-Pro-Arg-Lys-Phe | Thr-Thr-Lys-Pro-Arg-Lys-Phe | 2450 |
| Ala-Thr-Lys-Pro-Phe | Ala-Thr-Lys-Pro-Phe | Ala-Thr-Lys-Pro-Phe | 2451 |
| Ala-Thr-Lys-Pro-Arg-Phe | Ala-Thr-Lys-Pro-Arg-Phe | Ala-Thr-Lys-Pro-Arg-Phe | 2452 |
| Ala-Thr-Lys-Pro-Phe-Phe | Ala-Thr-Lys-Pro-Phe-Phe | Ala-Thr-Lys-Pro-Phe-Phe | 2453 |
| Ala-Thr-Lys-Pro-Tyr-Phe | Ala-Thr-Lys-Pro-Tyr-Phe | Ala-Thr-Lys-Pro-Tyr-Phe | 2454 |
| Ala-Thr-Lys-Pro-Gly-Phe | Ala-Thr-Lys-Pro-Gly-Phe | Ala-Thr-Lys-Pro-Gly-Phe | 2455 |
| Ala-Thr-Lys-Pro-His-Phe | Ala-Thr-Lys-Pro-His-Phe | Ala-Thr-Lys-Pro-His-Phe | 2456 |
| Ala-Thr-Lys-Pro-Lys-Phe | Ala-Thr-Lys-Pro-Lys-Phe | Ala-Thr-Lys-Pro-Lys-Phe | 2457 |
| Ala-Thr-Lys-Pro-Gly-Phe | Ala-Thr-Lys-Pro-Gly-Phe | Ala-Thr-Lys-Pro-Gly-Phe | 2458 |
| Ala-Thr-Lys-Pro-Gly-Arg-Phe | Ala-Thr-Lys-Pro-Gly-Arg-Phe | Ala-Thr-Lys-Pro-Gly-Arg-Phe | 2459 |
| Ala-Thr-Lys-Pro-Gly-Phe-Phe | Ala-Thr-Lys-Pro-Gly-Phe-Phe | Ala-Thr-Lys-Pro-Gly-Phe-Phe | 2460 |
| Ala-Thr-Lys-Pro-Gly-Tyr-Phe | Ala-Thr-Lys-Pro-Gly-Tyr-Phe | Ala-Thr-Lys-Pro-Gly-Tyr-Phe | 2461 |
| Ala-Thr-Lys-Pro-Gly-His-Phe | Ala-Thr-Lys-Pro-Gly-His-Phe | Ala-Thr-Lys-Pro-Gly-His-Phe | 2462 |
| Ala-Thr-Lys-Pro-Gly-Pro-Phe | Ala-Thr-Lys-Pro-Gly-Pro-Phe | Ala-Thr-Lys-Pro-Gly-Pro-Phe | 2463 |
| Ala-Thr-Lys-Pro-Gly-Lys-Phe | Ala-Thr-Lys-Pro-Gly-Lys-Phe | Ala-Thr-Lys-Pro-Gly-Lys-Phe | 2464 |
| Ala-Thr-Lys-Pro-Asp-Phe | Ala-Thr-Lys-Pro-Asp-Phe | Ala-Thr-Lys-Pro-Asp-Phe | 2465 |
| Ala-Thr-Lys-Pro-Asp-Arg-Phe | Ala-Thr-Lys-Pro-Asp-Arg-Phe | Ala-Thr-Lys-Pro-Asp-Arg-Phe | 2466 |
| Ala-Thr-Lys-Pro-Asp-Phe-Phe | Ala-Thr-Lys-Pro-Asp-Phe-Phe | Ala-Thr-Lys-Pro-Asp-Phe-Phe | 2467 |
| Ala-Thr-Lys-Pro-Asp-Tyr-Phe | Ala-Thr-Lys-Pro-Asp-Tyr-Phe | Ala-Thr-Lys-Pro-Asp-Tyr-Phe | 2468 |
| Ala-Thr-Lys-Pro-Asp-His-Phe | Ala-Thr-Lys-Pro-Asp-His-Phe | Ala-Thr-Lys-Pro-Asp-His-Phe | 2469 |
| Ala-Thr-Lys-Pro-Asp-Pro-Phe | Ala-Thr-Lys-Pro-Asp-Pro-Phe | Ala-Thr-Lys-Pro-Asp-Pro-Phe | 2470 |
| Ala-Thr-Lys-Pro-Asp-Lys-Phe | Ala-Thr-Lys-Pro-Asp-Lys-Phe | Ala-Thr-Lys-Pro-Asp-Lys-Phe | 2471 |
| Ala-Thr-Lys-Pro-Trp-Phe | Ala-Thr-Lys-Pro-Trp-Phe | Ala-Thr-Lys-Pro-Trp-Phe | 2472 |
| Ala-Thr-Lys-Pro-Trp-Arg-Phe | Ala-Thr-Lys-Pro-Trp-Arg-Phe | Ala-Thr-Lys-Pro-Trp-Arg-Phe | 2473 |
| Ala-Thr-Lys-Pro-Trp-Phe-Phe | Ala-Thr-Lys-Pro-Trp-Phe-Phe | Ala-Thr-Lys-Pro-Trp-Phe-Phe | 2474 |
| Ala-Thr-Lys-Pro-Trp-Tyr-Phe | Ala-Thr-Lys-Pro-Trp-Tyr-Phe | Ala-Thr-Lys-Pro-Trp-Tyr-Phe | 2475 |
| Ala-Thr-Lys-Pro-Trp-His-Phe | Ala-Thr-Lys-Pro-Trp-His-Phe | Ala-Thr-Lys-Pro-Trp-His-Phe | 2476 |
| Ala-Thr-Lys-Pro-Trp-Pro-Phe | Ala-Thr-Lys-Pro-Trp-Pro-Phe | Ala-Thr-Lys-Pro-Trp-Pro-Phe | 2477 |
| Ala-Thr-Lys-Pro-Trp-Lys-Phe | Ala-Thr-Lys-Pro-Trp-Lys-Phe | Ala-Thr-Lys-Pro-Trp-Lys-Phe | 2478 |
| Ala-Thr-Lys-Pro-Gln-Phe | Ala-Thr-Lys-Pro-Gln-Phe | Ala-Thr-Lys-Pro-Gln-Phe | 2479 |
| Ala-Thr-Lys-Pro-Gln-Arg-Phe | Ala-Thr-Lys-Pro-Gln-Arg-Phe | Ala-Thr-Lys-Pro-Gln-Arg-Phe | 2480 |
| Ala-Thr-Lys-Pro-Gln-Phe-Phe | Ala-Thr-Lys-Pro-Gln-Phe-Phe | Ala-Thr-Lys-Pro-Gln-Phe-Phe | 2481 |
| Ala-Thr-Lys-Pro-Gln-Tyr-Phe | Ala-Thr-Lys-Pro-Gln-Tyr-Phe | Ala-Thr-Lys-Pro-Gln-Tyr-Phe | 2482 |
| Ala-Thr-Lys-Pro-Gln-His-Phe | Ala-Thr-Lys-Pro-Gln-His-Phe | Ala-Thr-Lys-Pro-Gln-His-Phe | 2483 |
| Ala-Thr-Lys-Pro-Gln-Pro-Phe | Ala-Thr-Lys-Pro-Gln-Pro-Phe | Ala-Thr-Lys-Pro-Gln-Pro-Phe | 2484 |
| Ala-Thr-Lys-Pro-Gln-Lys-Phe | Ala-Thr-Lys-Pro-Gln-Lys-Phe | Ala-Thr-Lys-Pro-Gln-Lys-Phe | 2485 |
| Ala-Thr-Lys-Pro-Asn-Phe | Ala-Thr-Lys-Pro-Asn-Phe | Ala-Thr-Lys-Pro-Asn-Phe | 2486 |
| Ala-Thr-Lys-Pro-Asn-Arg-Phe | Ala-Thr-Lys-Pro-Asn-Arg-Phe | Ala-Thr-Lys-Pro-Asn-Arg-Phe | 2487 |

TABLE 1-continued

| X-OH | X-OCH₃ | X-NH₂ | SEQ ID NO |
|---|---|---|---|
| Ala-Thr-Lys-Pro-Asn-Phe-Phe | Ala-Thr-Lys-Pro-Asn-Phe-Phe | Ala-Thr-Lys-Pro-Asn-Phe-Phe | 2488 |
| Ala-Thr-Lys-Pro-Asn-Tyr-Phe | Ala-Thr-Lys-Pro-Asn-Tyr-Phe | Ala-Thr-Lys-Pro-Asn-Tyr-Phe | 2489 |
| Ala-Thr-Lys-Pro-Asn-His-Phe | Ala-Thr-Lys-Pro-Asn-His-Phe | Ala-Thr-Lys-Pro-Asn-His-Phe | 2490 |
| Ala-Thr-Lys-Pro-Asn-Pro-Phe | Ala-Thr-Lys-Pro-Asn-Pro-Phe | Ala-Thr-Lys-Pro-Asn-Pro-Phe | 2491 |
| Ala-Thr-Lys-Pro-Asn-Lys-Phe | Ala-Thr-Lys-Pro-Asn-Lys-Phe | Ala-Thr-Lys-Pro-Asn-Lys-Phe | 2492 |
| Ala-Thr-Lys-Pro-Tyr-Phe | Ala-Thr-Lys-Pro-Tyr-Phe | Ala-Thr-Lys-Pro-Tyr-Phe | 2493 |
| Ala-Thr-Lys-Pro-Tyr-Arg-Phe | Ala-Thr-Lys-Pro-Tyr-Arg-Phe | Ala-Thr-Lys-Pro-Tyr-Arg-Phe | 2494 |
| Ala-Thr-Lys-Pro-Tyr-Phe-Phe | Ala-Thr-Lys-Pro-Tyr-Phe-Phe | Ala-Thr-Lys-Pro-Tyr-Phe-Phe | 2495 |
| Ala-Thr-Lys-Pro-Tyr-Tyr-Phe | Ala-Thr-Lys-Pro-Tyr-Tyr-Phe | Ala-Thr-Lys-Pro-Tyr-Tyr-Phe | 2496 |
| Ala-Thr-Lys-Pro-Tyr-His-Phe | Ala-Thr-Lys-Pro-Tyr-His-Phe | Ala-Thr-Lys-Pro-Tyr-His-Phe | 2497 |
| Ala-Thr-Lys-Pro-Tyr-Pro-Phe | Ala-Thr-Lys-Pro-Tyr-Pro-Phe | Ala-Thr-Lys-Pro-Tyr-Pro-Phe | 2498 |
| Ala-Thr-Lys-Pro-Tyr-Lys-Phe | Ala-Thr-Lys-Pro-Tyr-Lys-Phe | Ala-Thr-Lys-Pro-Tyr-Lys-Phe | 2499 |
| Ala-Thr-Lys-Pro-Arg-Phe | Ala-Thr-Lys-Pro-Arg-Phe | Ala-Thr-Lys-Pro-Arg-Phe | 2500 |
| Ala-Thr-Lys-Pro-Arg-Arg-Phe | Ala-Thr-Lys-Pro-Arg-Arg-Phe | Ala-Thr-Lys-Pro-Arg-Arg-Phe | 2501 |
| Ala-Thr-Lys-Pro-Arg-Phe-Phe | Ala-Thr-Lys-Pro-Arg-Phe-Phe | Ala-Thr-Lys-Pro-Arg-Phe-Phe | 2502 |
| Ala-Thr-Lys-Pro-Arg-Tyr-Phe | Ala-Thr-Lys-Pro-Arg-Tyr-Phe | Ala-Thr-Lys-Pro-Arg-Tyr-Phe | 2503 |
| Ala-Thr-Lys-Pro-Arg-His-Phe | Ala-Thr-Lys-Pro-Arg-His-Phe | Ala-Thr-Lys-Pro-Arg-His-Phe | 2504 |
| Ala-Thr-Lys-Pro-Arg-Pro-Phe | Ala-Thr-Lys-Pro-Arg-Pro-Phe | Ala-Thr-Lys-Pro-Arg-Pro-Phe | 2505 |
| Ala-Thr-Lys-Pro-Arg-Lys-Phe | Ala-Thr-Lys-Pro-Arg-Lys-Phe | Ala-Thr-Lys-Pro-Arg-Lys-Phe | 2506 |
| His-Thr-Lys-Pro-Phe | His-Thr-Lys-Pro-Phe | His-Thr-Lys-Pro-Phe | 2507 |
| His-Thr-Lys-Pro-Arg-Phe | His-Thr-Lys-Pro-Arg-Phe | His-Thr-Lys-Pro-Arg-Phe | 2508 |
| His-Thr-Lys-Pro-Phe-Phe | His-Thr-Lys-Pro-Phe-Phe | His-Thr-Lys-Pro-Phe-Phe | 2509 |
| His-Thr-Lys-Pro-Tyr-Phe | His-Thr-Lys-Pro-Tyr-Phe | His-Thr-Lys-Pro-Tyr-Phe | 2510 |
| His-Thr-Lys-Pro-Gly-Phe | His-Thr-Lys-Pro-Gly-Phe | His-Thr-Lys-Pro-Gly-Phe | 2511 |
| His-Thr-Lys-Pro-His-Phe | His-Thr-Lys-Pro-His-Phe | His-Thr-Lys-Pro-His-Phe | 2512 |
| His-Thr-Lys-Pro-Lys-Phe | His-Thr-Lys-Pro-Lys-Phe | His-Thr-Lys-Pro-Lys-Phe | 2513 |
| His-Thr-Lys-Pro-Gly-Phe | His-Thr-Lys-Pro-Gly-Phe | His-Thr-Lys-Pro-Gly-Phe | 2514 |
| His-Thr-Lys-Pro-Gly-Arg-Phe | His-Thr-Lys-Pro-Gly-Arg-Phe | His-Thr-Lys-Pro-Gly-Arg-Phe | 2515 |
| His-Thr-Lys-Pro-Gly-Phe-Phe | His-Thr-Lys-Pro-Gly-Phe-Phe | His-Thr-Lys-Pro-Gly-Phe-Phe | 2516 |
| His-Thr-Lys-Pro-Gly-Tyr-Phe | His-Thr-Lys-Pro-Gly-Tyr-Phe | His-Thr-Lys-Pro-Gly-Tyr-Phe | 2517 |
| His-Thr-Lys-Pro-Gly-His-Phe | His-Thr-Lys-Pro-Gly-His-Phe | His-Thr-Lys-Pro-Gly-His-Phe | 2518 |
| His-Thr-Lys-Pro-Gly-Pro-Phe | His-Thr-Lys-Pro-Gly-Pro-Phe | His-Thr-Lys-Pro-Gly-Pro-Phe | 2519 |
| His-Thr-Lys-Pro-Gly-Lys-Phe | His-Thr-Lys-Pro-Gly-Lys-Phe | His-Thr-Lys-Pro-Gly-Lys-Phe | 2520 |
| His-Thr-Lys-Pro-Asp-Phe | His-Thr-Lys-Pro-Asp-Phe | His-Thr-Lys-Pro-Asp-Phe | 2521 |
| His-Thr-Lys-Pro-Asp-Arg-Phe | His-Thr-Lys-Pro-Asp-Arg-Phe | His-Thr-Lys-Pro-Asp-Arg-Phe | 2522 |
| His-Thr-Lys-Pro-Asp-Phe-Phe | His-Thr-Lys-Pro-Asp-Phe-Phe | His-Thr-Lys-Pro-Asp-Phe-Phe | 2523 |
| His-Thr-Lys-Pro-Asp-Tyr-Phe | His-Thr-Lys-Pro-Asp-Tyr-Phe | His-Thr-Lys-Pro-Asp-Tyr-Phe | 2524 |
| His-Thr-Lys-Pro-Asp-His-Phe | His-Thr-Lys-Pro-Asp-His-Phe | His-Thr-Lys-Pro-Asp-His-Phe | 2525 |

TABLE 1-continued

| X-OH | X-OCH₃ | X-NH₂ | SEQ ID NO |
|---|---|---|---|
| His-Thr-Lys-Pro-Asp-Pro-Phe | His-Thr-Lys-Pro-Asp-Pro-Phe | His-Thr-Lys-Pro-Asp-Pro-Phe | 2526 |
| His-Thr-Lys-Pro-Asp-Lys-Phe | His-Thr-Lys-Pro-Asp-Lys-Phe | His-Thr-Lys-Pro-Asp-Lys-Phe | 2527 |
| His-Thr-Lys-Pro-Trp-Phe | His-Thr-Lys-Pro-Trp-Phe | His-Thr-Lys-Pro-Trp-Phe | 2528 |
| His-Thr-Lys-Pro-Trp-Arg-Ph | eHis-Thr-Lys-Pro-Trp-Arg-Phe | His-Thr-Lys-Pro-Trp-Arg-Phe | 2529 |
| His-Thr-Lys-Pro-Trp-Phe-Phe | His-Thr-Lys-Pro-Trp-Phe-Phe | His-Thr-Lys-Pro-Trp-Phe-Phe | 2530 |
| His-Thr-Lys-Pro-Trp-Tyr-Phe | His-Thr-Lys-Pro-Trp-Tyr-Phe | His-Thr-Lys-Pro-Trp-Tyr-Phe | 2531 |
| His-Thr-Lys-Pro-Trp-His-Phe | His-Thr-Lys-Pro-Trp-His-Phe | His-Thr-Lys-Pro-Trp-His-Phe | 2532 |
| His-Thr-Lys-Pro-Trp-Pro-Phe | His-Thr-Lys-Pro-Trp-Pro-Phe | His-Thr-Lys-Pro-Trp-Pro-Phe | 2533 |
| His-Thr-Lys-Pro-Trp-Lys-Phe | His-Thr-Lys-Pro-Trp-Lys-Phe | His-Thr-Lys-Pro-Trp-Lys-Phe | 2534 |
| His-Thr-Lys-Pro-Gln-Phe | His-Thr-Lys-Pro-Gln-Phe | His-Thr-Lys-Pro-Gln-Phe | 2535 |
| His-Thr-Lys-Pro-Gln-Arg-Phe | His-Thr-Lys-Pro-Gln-Arg-Phe | His-Thr-Lys-Pro-Gln-Arg-Phe | 2536 |
| His-Thr-Lys-Pro-Gln-Phe-Phe | His-Thr-Lys-Pro-Gln-Phe-Phe | His-Thr-Lys-Pro-Gln-Phe-Phe | 2537 |
| His-Thr-Lys-Pro-Gln-Tyr-Phe | His-Thr-Lys-Pro-Gln-Tyr-Phe | His-Thr-Lys-Pro-Gln-Tyr-Phe | 2538 |
| His-Thr-Lys-Pro-Gln-His-Phe | His-Thr-Lys-Pro-Gln-His-Phe | His-Thr-Lys-Pro-Gln-His-Phe | 2539 |
| His-Thr-Lys-Pro-Gln-Pro-Phe | His-Thr-Lys-Pro-Gln-Pro-Phe | His-Thr-Lys-Pro-Gln-Pro-Phe | 2540 |
| His-Thr-Lys-Pro-Gln-Lys-Phe | His-Thr-Lys-Pro-Gln-Lys-Phe | His-Thr-Lys-Pro-Gln-Lys-Phe | 2541 |
| His-Thr-Lys-Pro-Asn-Phe | His-Thr-Lys-Pro-Asn-Phe | His-Thr-Lys-Pro-Asn-Phe | 2542 |
| His-Thr-Lys-Pro-Asn-Arg-Phe | His-Thr-Lys-Pro-Asn-Arg-Phe | His-Thr-Lys-Pro-Asn-Arg-Phe | 2543 |
| His-Thr-Lys-Pro-Asn-Phe-Phe | His-Thr-Lys-Pro-Asn-Phe-Phe | His-Thr-Lys-Pro-Asn-Phe-Phe | 2544 |
| His-Thr-Lys-Pro-Asn-Tyr-Phe | His-Thr-Lys-Pro-Asn-Tyr-Phe | His-Thr-Lys-Pro-Asn-Tyr-Phe | 2545 |
| His-Thr-Lys-Pro-Asn-His-Phe | His-Thr-Lys-Pro-Asn-His-Phe | His-Thr-Lys-Pro-Asn-His-Phe | 2546 |
| His-Thr-Lys-Pro-Asn-Pro-Phe | His-Thr-Lys-Pro-Asn-Pro-Phe | His-Thr-Lys-Pro-Asn-Pro-Phe | 2547 |
| His-Thr-Lys-Pro-Asn-Lys-Phe | His-Thr-Lys-Pro-Asn-Lys-Phe | His-Thr-Lys-Pro-Asn-Lys-Phe | 2548 |
| His-Thr-Lys-Pro-Tyr-Phe | His-Thr-Lys-Pro-Tyr-Phe | His-Thr-Lys-Pro-Tyr-Phe | 2549 |
| His-Thr-Lys-Pro-Tyr-Arg-Phe | His-Thr-Lys-Pro-Tyr-Arg-Phe | His-Thr-Lys-Pro-Tyr-Arg-Phe | 2550 |
| His-Thr-Lys-Pro-Tyr-Phe-Phe | His-Thr-Lys-Pro-Tyr-Phe-Phe | His-Thr-Lys-Pro-Tyr-Phe-Phe | 2551 |
| His-Thr-Lys-Pro-Tyr-Tyr-Phe | His-Thr-Lys-Pro-Tyr-Tyr-Phe | His-Thr-Lys-Pro-Tyr-Tyr-Phe | 2552 |
| His-Thr-Lys-Pro-Tyr-His-Phe | His-Thr-Lys-Pro-Tyr-His-Phe | His-Thr-Lys-Pro-Tyr-His-Phe | 2553 |
| His-Thr-Lys-Pro-Tyr-Pro-Phe | His-Thr-Lys-Pro-Tyr-Pro-Phe | His-Thr-Lys-Pro-Tyr-Pro-Phe | 2554 |
| His-Thr-Lys-Pro-Tyr-Lys-Phe | His-Thr-Lys-Pro-Tyr-Lys-Phe | His-Thr-Lys-Pro-Tyr-Lys-Phe | 2555 |
| His-Thr-Lys-Pro-Arg-Phe | His-Thr-Lys-Pro-Arg-Phe | His-Thr-Lys-Pro-Arg-Phe | 2556 |
| His-Thr-Lys-Pro-Arg-Arg-Phe | His-Thr-Lys-Pro-Arg-Arg-Phe | His-Thr-Lys-Pro-Arg-Arg-Phe | 2557 |
| His-Thr-Lys-Pro-Arg-Phe-Phe | His-Thr-Lys-Pro-Arg-Phe-Phe | His-Thr-Lys-Pro-Arg-Phe-Phe | 2558 |
| His-Thr-Lys-Pro-Arg-Tyr-Phe | His-Thr-Lys-Pro-Arg-Tyr-Phe | His-Thr-Lys-Pro-Arg-Tyr-Phe | 2559 |
| His-Thr-Lys-Pro-Arg-His-Phe | His-Thr-Lys-Pro-Arg-His-Phe | His-Thr-Lys-Pro-Arg-His-Phe | 2560 |
| His-Thr-Lys-Pro-Arg-Pro-Phe | His-Thr-Lys-Pro-Arg-Pro-Phe | His-Thr-Lys-Pro-Arg-Pro-Phe | 2561 |
| His-Thr-Lys-Pro-Arg-Lys-Phe | His-Thr-Lys-Pro-Arg-Lys-Phe | His-Thr-Lys-Pro-Arg-Lys-Phe | 2562 |
| Lys-Thr-Lys-Pro-Phe | Lys-Thr-Lys-Pro-Phe | Lys-Thr-Lys-Pro-Phe | 2563 |

TABLE 1-continued

| X-OH | X-OCH₃ | X-NH₂ | SEQ ID NO |
|---|---|---|---|
| Lys-Thr-Lys-Pro-Arg-Phe | Lys-Thr-Lys-Pro-Arg-Phe | Lys-Thr-Lys-Pro-Arg-Phe | 2564 |
| Lys-Thr-Lys-Pro-Phe-Phe | Lys-Thr-Lys-Pro-Phe-Phe | Lys-Thr-Lys-Pro-Phe-Phe | 2565 |
| Lys-Thr-Lys-Pro-Tyr-Phe | Lys-Thr-Lys-Pro-Tyr-Phe | Lys-Thr-Lys-Pro-Tyr-Phe | 2566 |
| Lys-Thr-Lys-Pro-Gly-Phe | Lys-Thr-Lys-Pro-Gly-Phe | Lys-Thr-Lys-Pro-Gly-Phe | 2567 |
| Lys-Thr-Lys-Pro-His-Phe | Lys-Thr-Lys-Pro-His-Phe | Lys-Thr-Lys-Pro-His-Phe | 2568 |
| Lys-Thr-Lys-Pro-Lys-Phe | Lys-Thr-Lys-Pro-Lys-Phe | Lys-Thr-Lys-Pro-Lys-Phe | 2569 |
| Lys-Thr-Lys-Pro-Gly-Phe | Lys-Thr-Lys-Pro-Gly-Phe | Lys-Thr-Lys-Pro-Gly-Phe | 2570 |
| Lys-Thr-Lys-Pro-Gly-Arg-Phe | Lys-Thr-Lys-Pro-Gly-Arg-Phe | Lys-Thr-Lys-Pro-Gly-Arg-Phe | 2571 |
| Lys-Thr-Lys-Pro-Gly-Phe-Phe | Lys-Thr-Lys-Pro-Gly-Phe-Phe | Lys-Thr-Lys-Pro-Gly-Phe-Phe | 2572 |
| Lys-Thr-Lys-Pro-Gly-Tyr-Phe | Lys-Thr-Lys-Pro-Gly-Tyr-Phe | Lys-Thr-Lys-Pro-Gly-Tyr-Phe | 2573 |
| Lys-Thr-Lys-Pro-Gly-His-Phe | Lys-Thr-Lys-Pro-Gly-His-Phe | Lys-Thr-Lys-Pro-Gly-His-Phe | 2574 |
| Lys-Thr-Lys-Pro-Gly-Pro-Phe | Lys-Thr-Lys-Pro-Gly-Pro-Phe | Lys-Thr-Lys-Pro-Gly-Pro-Phe | 2575 |
| Lys-Thr-Lys-Pro-Gly-Lys-Phe | Lys-Thr-Lys-Pro-Gly-Lys-Phe | Lys-Thr-Lys-Pro-Gly-Lys-Phe | 2576 |
| Lys-Thr-Lys-Pro-Asp-Phe | Lys-Thr-Lys-Pro-Asp-Phe | Lys-Thr-Lys-Pro-Asp-Phe | 2577 |
| Lys-Thr-Lys-Pro-Asp-Arg-Phe | Lys-Thr-Lys-Pro-Asp-Arg-Phe | Lys-Thr-Lys-Pro-Asp-Arg-Phe | 2578 |
| Lys-Thr-Lys-Pro-Asp-Phe-Phe | Lys-Thr-Lys-Pro-Asp-Phe-Phe | Lys-Thr-Lys-Pro-Asp-Phe-Phe | 2579 |
| Lys-Thr-Lys-Pro-Asp-Tyr-Phe | Lys-Thr-Lys-Pro-Asp-Tyr-Phe | Lys-Thr-Lys-Pro-Asp-Tyr-Phe | 2580 |
| Lys-Thr-Lys-Pro-Asp-His-Phe | Lys-Thr-Lys-Pro-Asp-His-Phe | Lys-Thr-Lys-Pro-Asp-His-Phe | 2581 |
| Lys-Thr-Lys-Pro-Asp-Pro-Phe | Lys-Thr-Lys-Pro-Asp-Pro-Phe | Lys-Thr-Lys-Pro-Asp-Pro-Phe | 2582 |
| Lys-Thr-Lys-Pro-Asp-Lys-Phe | Lys-Thr-Lys-Pro-Asp-Lys-Phe | Lys-Thr-Lys-Pro-Asp-Lys-Phe | 2583 |
| Lys-Thr-Lys-Pro-Trp-Phe | Lys-Thr-Lys-Pro-Trp-Phe | Lys-Thr-Lys-Pro-Trp-Phe | 2584 |
| Lys-Thr-Lys-Pro-Trp-Arg-Phe | Lys-Thr-Lys-Pro-Trp-Arg-Phe | Lys-Thr-Lys-Pro-Trp-Arg-Phe | 2585 |
| Lys-Thr-Lys-Pro-Trp-Phe-Phe | Lys-Thr-Lys-Pro-Trp-Phe-Phe | Lys-Thr-Lys-Pro-Trp-Phe-Phe | 2586 |
| Lys-Thr-Lys-Pro-Trp-Tyr-Phe | Lys-Thr-Lys-Pro-Trp-Tyr-Phe | Lys-Thr-Lys-Pro-Trp-Tyr-Phe | 2587 |
| Lys-Thr-Lys-Pro-Trp-His-Phe | Lys-Thr-Lys-Pro-Trp-His-Phe | Lys-Thr-Lys-Pro-Trp-His-Phe | 2588 |
| Lys-Thr-Lys-Pro-Trp-Pro-Phe | Lys-Thr-Lys-Pro-Trp-Pro-Phe | Lys-Thr-Lys-Pro-Trp-Pro-Phe | 2589 |
| Lys-Thr-Lys-Pro-Trp-Lys-Phe | Lys-Thr-Lys-Pro-Trp-Lys-Phe | Lys-Thr-Lys-Pro-Trp-Lys-Phe | 2590 |
| Lys-Thr-Lys-Pro-Gln-Phe | Lys-Thr-Lys-Pro-Gln-Phe | Lys-Thr-Lys-Pro-Gln-Phe | 2591 |
| Lys-Thr-Lys-Pro-Gln-Arg-Phe | Lys-Thr-Lys-Pro-Gln-Arg-Phe | Lys-Thr-Lys-Pro-Gln-Arg-Phe | 2592 |
| Lys-Thr-Lys-Pro-Gln-Phe-Phe | Lys-Thr-Lys-Pro-Gln-Phe-Phe | Lys-Thr-Lys-Pro-Gln-Phe-Phe | 2593 |
| Lys-Thr-Lys-Pro-Gln-Tyr-Phe | Lys-Thr-Lys-Pro-Gln-Tyr-Phe | Lys-Thr-Lys-Pro-Gln-Tyr-Phe | 2594 |
| Lys-Thr-Lys-Pro-Gln-His-Phe | Lys-Thr-Lys-Pro-Gln-His-Phe | Lys-Thr-Lys-Pro-Gln-His-Phe | 2595 |
| Lys-Thr-Lys-Pro-Gln-Pro-Phe | Lys-Thr-Lys-Pro-Gln-Pro-Phe | Lys-Thr-Lys-Pro-Gln-Pro-Phe | 2596 |
| Lys-Thr-Lys-Pro-Gln-Lys-Phe | Lys-Thr-Lys-Pro-Gln-Lys-Phe | Lys-Thr-Lys-Pro-Gln-Lys-Phe | 2597 |
| Lys-Thr-Lys-Pro-Asn-Phe | Lys-Thr-Lys-Pro-Asn-Phe | Lys-Thr-Lys-Pro-Asn-Phe | 2598 |
| Lys-Thr-Lys-Pro-Asn-Arg-Phe | Lys-Thr-Lys-Pro-Asn-Arg-Phe | Lys-Thr-Lys-Pro-Asn-Arg-Phe | 2599 |
| Lys-Thr-Lys-Pro-Asn-Phe-Phe | Lys-Thr-Lys-Pro-Asn-Phe-Phe | Lys-Thr-Lys-Pro-Asn-Phe-Phe | 2600 |
| Lys-Thr-Lys-Pro-Asn-Tyr-Phe | Lys-Thr-Lys-Pro-Asn-Tyr-Phe | Lys-Thr-Lys-Pro-Asn-Tyr-Phe | 2601 |

TABLE 1-continued

| X-OH | X-OCH₃ | X-NH₂ | SEQ ID NO |
|---|---|---|---|
| Lys-Thr-Lys-Pro-Asn-His-Phe | Lys-Thr-Lys-Pro-Asn-His-Phe | Lys-Thr-Lys-Pro-Asn-His-Phe | 2602 |
| Lys-Thr-Lys-Pro-Asn-Pro-Phe | Lys-Thr-Lys-Pro-Asn-Pro-Phe | Lys-Thr-Lys-Pro-Asn-Pro-Phe | 2603 |
| Lys-Thr-Lys-Pro-Asn-Lys-Phe | Lys-Thr-Lys-Pro-Asn-Lys-Phe | Lys-Thr-Lys-Pro-Asn-Lys-Phe | 2604 |
| Lys-Thr-Lys-Pro-Tyr-Phe | Lys-Thr-Lys-Pro-Tyr-Phe | Lys-Thr-Lys-Pro-Tyr-Phe | 2605 |
| Lys-Thr-Lys-Pro-Tyr-Arg-Phe | Lys-Thr-Lys-Pro-Tyr-Arg-Phe | Lys-Thr-Lys-Pro-Tyr-Arg-Phe | 2606 |
| Lys-Thr-Lys-Pro-Tyr-Phe-Phe | Lys-Thr-Lys-Pro-Tyr-Phe-Phe | Lys-Thr-Lys-Pro-Tyr-Phe-Phe | 2607 |
| Lys-Thr-Lys-Pro-Tyr-Tyr-Phe | Lys-Thr-Lys-Pro-Tyr-Tyr-Phe | Lys-Thr-Lys-Pro-Tyr-Tyr-Phe | 2608 |
| Lys-Thr-Lys-Pro-Tyr-His-Phe | Lys-Thr-Lys-Pro-Tyr-His-Phe | Lys-Thr-Lys-Pro-Tyr-His-Phe | 2609 |
| Lys-Thr-Lys-Pro-Tyr-Pro-Phe | Lys-Thr-Lys-Pro-Tyr-Pro-Phe | Lys-Thr-Lys-Pro-Tyr-Pro-Phe | 2610 |
| Lys-Thr-Lys-Pro-Tyr-Lys-Phe | Lys-Thr-Lys-Pro-Tyr-Lys-Phe | Lys-Thr-Lys-Pro-Tyr-Lys-Phe | 2611 |
| Lys-Thr-Lys-Pro-Arg-Phe | Lys-Thr-Lys-Pro-Arg-Phe | Lys-Thr-Lys-Pro-Arg-Phe | 2612 |
| Lys-Thr-Lys-Pro-Arg-Arg-Phe | Lys-Thr-Lys-Pro-Arg-Arg-Phe | Lys-Thr-Lys-Pro-Arg-Arg-Phe | 2613 |
| Lys-Thr-Lys-Pro-Arg-Phe-Phe | Lys-Thr-Lys-Pro-Arg-Phe-Phe | Lys-Thr-Lys-Pro-Arg-Phe-Phe | 2614 |
| Lys-Thr-Lys-Pro-Arg-Tyr-Phe | Lys-Thr-Lys-Pro-Arg-Tyr-Phe | Lys-Thr-Lys-Pro-Arg-Tyr-Phe | 2615 |
| Lys-Thr-Lys-Pro-Arg-His-Phe | Lys-Thr-Lys-Pro-Arg-His-Phe | Lys-Thr-Lys-Pro-Arg-His-Phe | 2616 |
| Lys-Thr-Lys-Pro-Arg-Pro-Phe | Lys-Thr-Lys-Pro-Arg-Pro-Phe | Lys-Thr-Lys-Pro-Arg-Pro-Phe | 2617 |
| Lys-Thr-Lys-Pro-Arg-Lys-Phe | Lys-Thr-Lys-Pro-Arg-Lys-Phe | Lys-Thr-Lys-Pro-Arg-Lys-Phe | 2618 |
| Gly-Thr-Lys-Pro-Phe | Gly-Thr-Lys-Pro-Phe | Gly-Thr-Lys-Pro-Phe | 2619 |
| Gly-Thr-Lys-Pro-Arg-Phe | Gly-Thr-Lys-Pro-Arg-Phe | Gly-Thr-Lys-Pro-Arg-Phe | 2620 |
| Gly-Thr-Lys-Pro-Phe-Phe | Gly-Thr-Lys-Pro-Phe-Phe | Gly-Thr-Lys-Pro-Phe-Phe | 2621 |
| Gly-Thr-Lys-Pro-Tyr-Phe | Gly-Thr-Lys-Pro-Tyr-Phe | Gly-Thr-Lys-Pro-Tyr-Phe | 2622 |
| Gly-Thr-Lys-Pro-Gly-Phe | Gly-Thr-Lys-Pro-Gly-Phe | Gly-Thr-Lys-Pro-Gly-Phe | 2623 |
| Gly-Thr-Lys-Pro-His-Phe | Gly-Thr-Lys-Pro-His-Phe | Gly-Thr-Lys-Pro-His-Phe | 2624 |
| Gly-Thr-Lys-Pro-Lys-Phe | Gly-Thr-Lys-Pro-Lys-Phe | Gly-Thr-Lys-Pro-Lys-Phe | 2625 |
| Gly-Thr-Lys-Pro-Gly-Phe | Gly-Thr-Lys-Pro-Gly-Phe | Gly-Thr-Lys-Pro-Gly-Phe | 2626 |
| Gly-Thr-Lys-Pro-Gly-Arg-Phe | Gly-Thr-Lys-Pro-Gly-Arg-Phe | Gly-Thr-Lys-Pro-Gly-Arg-Phe | 2627 |
| Gly-Thr-Lys-Pro-Gly-Phe-Phe | Gly-Thr-Lys-Pro-Gly-Phe-Phe | Gly-Thr-Lys-Pro-Gly-Phe-Phe | 2628 |
| Gly-Thr-Lys-Pro-Gly-Tyr-Phe | Gly-Thr-Lys-Pro-Gly-Tyr-Phe | Gly-Thr-Lys-Pro-Gly-Tyr-Phe | 2629 |
| Gly-Thr-Lys-Pro-Gly-His-Phe | Gly-Thr-Lys-Pro-Gly-His-Phe | Gly-Thr-Lys-Pro-Gly-His-Phe | 2630 |
| Gly-Thr-Lys-Pro-Gly-Pro-Phe | Gly-Thr-Lys-Pro-Gly-Pro-Phe | Gly-Thr-Lys-Pro-Gly-Pro-Phe | 2631 |
| Gly-Thr-Lys-Pro-Gly-Lys-Phe | Gly-Thr-Lys-Pro-Gly-Lys-Phe | Gly-Thr-Lys-Pro-Gly-Lys-Phe | 2632 |
| Gly-Thr-Lys-Pro-Asp-Phe | Gly-Thr-Lys-Pro-Asp-Phe | Gly-Thr-Lys-Pro-Asp-Phe | 2633 |
| Gly-Thr-Lys-Pro-Asp-Arg-Phe | Gly-Thr-Lys-Pro-Asp-Arg-Phe | Gly-Thr-Lys-Pro-Asp-Arg-Phe | 2634 |
| Gly-Thr-Lys-Pro-Asp-Phe-Phe | Gly-Thr-Lys-Pro-Asp-Phe-Phe | Gly-Thr-Lys-Pro-Asp-Phe-Phe | 2635 |
| Gly-Thr-Lys-Pro-Asp-Tyr-Phe | Gly-Thr-Lys-Pro-Asp-Tyr-Phe | Gly-Thr-Lys-Pro-Asp-Tyr-Phe | 2636 |
| Gly-Thr-Lys-Pro-Asp-His-Phe | Gly-Thr-Lys-Pro-Asp-His-Phe | Gly-Thr-Lys-Pro-Asp-His-Phe | 2637 |

TABLE 1-continued

| X-OH | X-OCH₃ | X-NH₂ | SEQ ID NO |
|---|---|---|---|
| Gly-Thr-Lys-Pro-Asp-Pro-Phe | Gly-Thr-Lys-Pro-Asp-Pro-Phe | Gly-Thr-Lys-Pro-Asp-Pro-Phe | 2638 |
| Gly-Thr-Lys-Pro-Asp-Lys-Phe | Gly-Thr-Lys-Pro-Asp-Lys-Phe | Gly-Thr-Lys-Pro-Asp-Lys-Phe | 2639 |
| Gly-Thr-Lys-Pro-Trp-Phe | Gly-Thr-Lys-Pro-Trp-Phe | Gly-Thr-Lys-Pro-Trp-Phe | 2640 |
| Gly-Thr-Lys-Pro-Trp-Arg-Phe | Gly-Thr-Lys-Pro-Trp-Arg-Phe | Gly-Thr-Lys-Pro-Trp-Arg-Phe | 2641 |
| Gly-Thr-Lys-Pro-Trp-Phe-Phe | Gly-Thr-Lys-Pro-Trp-Phe-Phe | Gly-Thr-Lys-Pro-Trp-Phe-Phe | 2642 |
| Gly-Thr-Lys-Pro-Trp-Tyr-Phe | Gly-Thr-Lys-Pro-Trp-Tyr-Phe | Gly-Thr-Lys-Pro-Trp-Tyr-Phe | 2643 |
| Gly-Thr-Lys-Pro-Trp-His-Phe | Gly-Thr-Lys-Pro-Trp-His-Phe | Gly-Thr-Lys-Pro-Trp-His-Phe | 2644 |
| Gly-Thr-Lys-Pro-Trp-Pro-Phe | Gly-Thr-Lys-Pro-Trp-Pro-Phe | Gly-Thr-Lys-Pro-Trp-Pro-Phe | 2645 |
| Gly-Thr-Lys-Pro-Trp-Lys-Phe | Gly-Thr-Lys-Pro-Trp-Lys-Phe | Gly-Thr-Lys-Pro-Trp-Lys-Phe | 2646 |
| Gly-Thr-Lys-Pro-Gln-Phe | Gly-Thr-Lys-Pro-Gln-Phe | Gly-Thr-Lys-Pro-Gln-Phe | 2647 |
| Gly-Thr-Lys-Pro-Gln-Arg-Phe | Gly-Thr-Lys-Pro-Gln-Arg-Phe | Gly-Thr-Lys-Pro-Gln-Arg-Phe | 2648 |
| Gly-Thr-Lys-Pro-Gln-Phe-Phe | Gly-Thr-Lys-Pro-Gln-Phe-Phe | Gly-Thr-Lys-Pro-Gln-Phe-Phe | 2649 |
| Gly-Thr-Lys-Pro-Gln-Tyr-Phe | Gly-Thr-Lys-Pro-Gln-Tyr-Phe | Gly-Thr-Lys-Pro-Gln-Tyr-Phe | 2650 |
| Gly-Thr-Lys-Pro-Gln-His-Phe | Gly-Thr-Lys-Pro-Gln-His-Phe | Gly-Thr-Lys-Pro-Gln-His-Phe | 2651 |
| Gly-Thr-Lys-Pro-Gln-Pro-Phe | Gly-Thr-Lys-Pro-Gln-Pro-Phe | Gly-Thr-Lys-Pro-Gln-Pro-Phe | 2652 |
| Gly-Thr-Lys-Pro-Gln-Lys-Phe | Gly-Thr-Lys-Pro-Gln-Lys-Phe | Gly-Thr-Lys-Pro-Gln-Lys-Phe | 2653 |
| Gly-Thr-Lys-Pro-Asn-Phe | Gly-Thr-Lys-Pro-Asn-Phe | Gly-Thr-Lys-Pro-Asn-Phe | 2654 |
| Gly-Thr-Lys-Pro-Asn-Arg-Phe | Gly-Thr-Lys-Pro-Asn-Arg-Phe | Gly-Thr-Lys-Pro-Asn-Arg-Phe | 2655 |
| Gly-Thr-Lys-Pro-Asn-Phe-Phe | Gly-Thr-Lys-Pro-Asn-Phe-Phe | Gly-Thr-Lys-Pro-Asn-Phe-Phe | 2656 |
| Gly-Thr-Lys-Pro-Asn-Tyr-Phe | Gly-Thr-Lys-Pro-Asn-Tyr-Phe | Gly-Thr-Lys-Pro-Asn-Tyr-Phe | 2657 |
| Gly-Thr-Lys-Pro-Asn-His-Phe | Gly-Thr-Lys-Pro-Asn-His-Phe | Gly-Thr-Lys-Pro-Asn-His-Phe | 2658 |
| Gly-Thr-Lys-Pro-Asn-Pro-Phe | Gly-Thr-Lys-Pro-Asn-Pro-Phe | Gly-Thr-Lys-Pro-Asn-Pro-Phe | 2659 |
| Gly-Thr-Lys-Pro-Asn-Lys-Phe | Gly-Thr-Lys-Pro-Asn-Lys-Phe | Gly-Thr-Lys-Pro-Asn-Lys-Phe | 2660 |
| Gly-Thr-Lys-Pro-Tyr-Phe | Gly-Thr-Lys-Pro-Tyr-Phe | Gly-Thr-Lys-Pro-Tyr-Phe | 2661 |
| Gly-Thr-Lys-Pro-Tyr-Arg-Phe | Gly-Thr-Lys-Pro-Tyr-Arg-Phe | Gly-Thr-Lys-Pro-Tyr-Arg-Phe | 2662 |
| Gly-Thr-Lys-Pro-Tyr-Phe-Phe | Gly-Thr-Lys-Pro-Tyr-Phe-Phe | Gly-Thr-Lys-Pro-Tyr-Phe-Phe | 2663 |
| Gly-Thr-Lys-Pro-Tyr-Tyr-Phe | Gly-Thr-Lys-Pro-Tyr-Tyr-Phe | Gly-Thr-Lys-Pro-Tyr-Tyr-Phe | 2664 |
| Gly-Thr-Lys-Pro-Tyr-His-Phe | Gly-Thr-Lys-Pro-Tyr-His-Phe | Gly-Thr-Lys-Pro-Tyr-His-Phe | 2665 |
| Gly-Thr-Lys-Pro-Tyr-Pro-Phe | Gly-Thr-Lys-Pro-Tyr-Pro-Phe | Gly-Thr-Lys-Pro-Tyr-Pro-Phe | 2666 |
| Gly-Thr-Lys-Pro-Tyr-Lys-Phe | Gly-Thr-Lys-Pro-Tyr-Lys-Phe | Gly-Thr-Lys-Pro-Tyr-Lys-Phe | 2667 |
| Gly-Thr-Lys-Pro-Arg-Phe | Gly-Thr-Lys-Pro-Arg-Phe | Gly-Thr-Lys-Pro-Arg-Phe | 2668 |
| Gly-Thr-Lys-Pro-Arg-Arg-Phe | Gly-Thr-Lys-Pro-Arg-Arg-Phe | Gly-Thr-Lys-Pro-Arg-Arg-Phe | 2669 |
| Gly-Thr-Lys-Pro-Arg-Phe-Phe | Gly-Thr-Lys-Pro-Arg-Phe-Phe | Gly-Thr-Lys-Pro-Arg-Phe-Phe | 2670 |
| Gly-Thr-Lys-Pro-Arg-Tyr-Phe | Gly-Thr-Lys-Pro-Arg-Tyr-Phe | Gly-Thr-Lys-Pro-Arg-Tyr-Phe | 2671 |
| Gly-Thr-Lys-Pro-Arg-His-Phe | Gly-Thr-Lys-Pro-Arg-His-Phe | Gly-Thr-Lys-Pro-Arg-His-Phe | 2672 |
| Gly-Thr-Lys-Pro-Arg-Pro-Phe | Gly-Thr-Lys-Pro-Arg-Pro-Phe | Gly-Thr-Lys-Pro-Arg-Pro-Phe | 2673 |
| Gly-Thr-Lys-Pro-Arg-Lys-Phe | Gly-Thr-Lys-Pro-Arg-Lys-Phe | Gly-Thr-Lys-Pro-Arg-Lys-Phe | 2674 |

BRIEF DESCRIPTION OF THE DRAWINGS

FIG. 1 shows a diagram of Arg-Pro-Gly-Pro (SEQ ID NO: 2676) tetrapeptide synthesis;

FIG. 2 shows a diagram of Pro-Arg-Pro-Gly-Pro (SEQ ID NO: 2675) pentapeptide synthesis;

FIG. 3 shows a diagram of Pro-Gly-Pro (SEQ ID NO: 2677) tripeptide synthesis;

BEST EXAMPLE OF THE INVENTION

Figure 4:
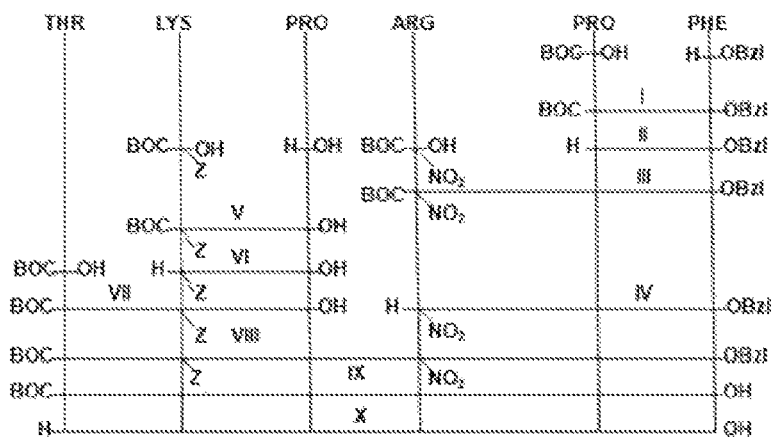
FIG. 4 shows a diagram of Thr-Lys-Pro-Arg-Pro-Phe (SEQ ID NO: 7) hexapeptide synthesis.

The following are the examples illustrating the invention.

Synthesis of peptides with the general formula A-Thr-Lys-Pro-B-C-D-X was performed by methods of peptide chemistry in solution using L-amino acids. Peptide synthesis was carried out by stepwise elongation of the peptide chain, as well as fragment condensation using mixed anhydride method, carbodiimide method with the addition of 1-hydroxybenzotriazole as an auxiliary nucleophile, activated ester method, and mixed anhydride method. All intermediate and final products were isolated and characterized. Evaporation of solutions was conducted using vacuum evaporator at 40° C. Melting points, determined with Boethius apparatus, are given without correction. Identity of the obtained compounds was tested by TLC on Silufol silica gel-coated plates (Czech Republic). Substances were detected by UV light using ninhydrin, Barton's reagent, Pauly reagent, Reindel-Hoppe reagent, and o-tolidine in chlorine environment. Specific rotation was determined by AI-EPO polarimeter. Peptide homogeneity was tested by high performance liquid chromatography (HPLC), and peptide structure was confirmed by mass spectrometric methods. All solvents were correspondingly absolutized. Melting points were not corrected.

Peptides were also obtained by genetic engineering techniques using host cells engineered by known laboratory strains of E. coli, transformed with known commercially available plasmids containing nucleic acid encoding the target peptide.

The examples describe peptide synthesis.

Example 1

Synthesis of Arg-Pro-Gly-Pro Tetrapeptide

Figures 1, 2, 3:
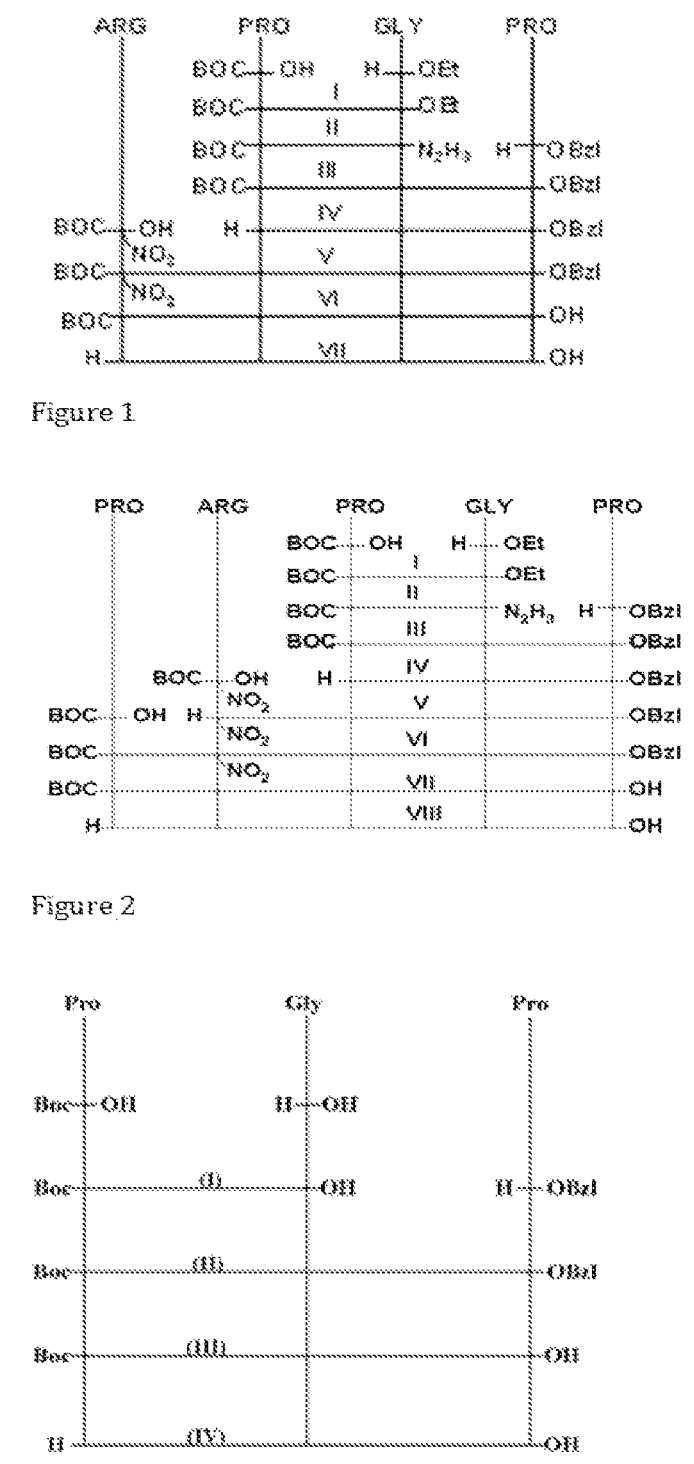

Synthesis of the tetrapeptide was performed according to the diagram shown in FIG. 1.

In synthesis, mixed anhydride method, azide method and carbodiimide method were used. Derivatives of L-amino acids were used for synthesis. Evaporation of solutions was conducted using rotor evaporator at 40° C. Melting points, determined with Boethius apparatus, are given without correction. Identity of the obtained compounds was tested by TLC on Silufol silica gel-coated plates (Czech Republic). Substances were detected by spraying the plate with a solution of ninhydrin and (or) o-tolidine. Substances were detected by spraying the plate with a solution of ninhydrin and (or) o-tolidine. Chromatographic mobility (Rf) values in the following solvent systems are provided: acetone:benzene:acetic acid (50:100:1)—(1); chloroform:methanol (9:1)—(2); hexane:acetone (3:2)—(3); butanol:acetic acid:water (4:1:1)—(4); butanol:acetic acid:pyridine:water (30:6:20:24)—(5); chloroform:methanol:ammonia (6:4:1)—(6); benzene:ethanol (8:2)—(7); Ethyl acetate:acetone:50% acetic acid:water (2:1:1)—(8); chloroform:methanol (14:1)—(9); chloroform:methanol:ammonia (8:1.75:0.25)—(10); chloroform:methanol:ammonia (6.5:3.0:0.5)—(11).

Specific rotation was determined by AI-EPO polarimeter.
Elemental analysis using Carlo-Erba model 1106 analyzer.

I. Boc-Pro-Gly-OEt.

8.3 g (3.45 mmol) of Boc-Pro-OH were dissolved in 50 ml of $CH_2Cl_2$, cooled down to 5° C.; then, 38.45 mmol (5.38 ml) of TEA were added. The reaction mixture was cooled down to −25÷−30° C. At this temperature, 38.45 mmol (4.84 ml) of isobutyl chloroformate were added using a pipette. The reaction mixture temperature was kept in the range of −18÷−20° C. for 20 minutes. Simultaneously, a solution of 5.9 g (42.3 mmol) of 1.1-fold excess of HCl.H-Gly-OEt in 75 ml of chloroform, containing 5.92 ml of TEA. The solution was cooled down to −25° C. and, after formation of mixed anhydride in the first flask, its contents were poured to the ether solution right away. The reaction mixture was incubated for 1 hour at −10° C. and then stirred for 12 hours at 4° C. on a magnetic stirrer. The reaction mixture was evaporated, then 250 ml of ethyl acetate were added; then, ethyl acetate solution was washed 3 times with 25 ml of 0.1N HCl, 3 times with 25 ml $H_2O$, and once with saturated solution of NaCl. The organic layer was dried over $MgSO_4$, filtered and evaporated. The residue was dried under vacuum over $P_2O_5$/KOH and paraffin.

Yield: 10.2 g (30.3 mmol) 78.83%
Rf–0.5 (7); 0.862 (8)
Melting point 68-70° C.

II. Boc-Pro-Gly-$N_2H_2$.

10.2 g of Boc-Pro-Gly-OEt (30.3 mmol) were dissolved in 80 ml of absolute methanol, and 4-fold excess of hydrazine hydrate, viz. 5.88 ml (121.2 mmol), was added. The solution was stirred for 12 hours on a magnetic stirrer at room temperature. The reaction mixture was evaporated, then two times evaporated with ether; then, ether (~5 ml) was poured over the residue and left in a refrigerator overnight (for better crystallization, seeding agent was added). The precipitated crystals were filtered, washed with ether using a filter and dried in a desiccator.

Yield: 6.9 g (20.79 mmol) 68.62%
Rf–0.284 (7); 0.474 (8); 0.189 (9)
Melting point 98-100° C.

III. Boc-Pro-Gly-Pro-OBzl.

58.4 mmol (4-fold excess) of hydrogen chloride in ethyl acetate were added to the solution of Boc-Pro-Gly-$N_2H_3$, containing 4.7 g (14.6 mmol) in 40 ml of DMF, cooled down to −20° C., and, immediately, 1.73 mL (14.6 mmol) of freshly distilled tert-butyl nitrite; then, the reaction mixture was stirred for 30 minutes at −5° C. The reaction mixture was cooled down to −40° C., and solution of 8.2 mL (58.4 mmol) of TEA in 4 mL of DMF, cooled down to −10° C., was added; when the temperature of the reaction mixture had risen to −20° C., 3.7 g (15.3 mmol) of 1.05-fold excess of HCl.H-Pro-OBzl were added to 20 ml of DMF and 2.14 ml of TEA. Then, it was stirred at 4° C. for 24 hours on a magnetic stirrer. The reaction mixture was evaporated, and the residue was dissolved in 200 mL of ethyl acetate and washed 2 times with 20 ml of $H_2O$, 3 times with 20 ml of 10% sodium $KHSO_4$, 3 times with 20 ml of $H_2O$, 3 times with 20 ml of 5% NaHCO3, and 3 times with 20 ml of $H_2O$. Ethyl acetate solution was dried over $MgSO_4$. Then it was evaporated, and a small amount of ether (~10 mL) was added to the residue. Then, it was left in a refrigerator for crystallization. For better product crystallization, seeding agent was added. The precipitated crystals were filtered and washed with a small amount of ether using a filter. Then, they were dried in a desiccator.
Yield: 5.358 g (11.65 mmol) 79.92%
Rf–0.326 (7); 0.947 (8); 0.390 (9)
Melting point 125-126° C.
[α]$_D^{22}$–101.18° (c=0.85; CH$_3$OH).
Elemental analysis: C, 62.89 (62.73); N, 9.21 (9.14); H, 7.52 (7.24).

IV. TFA.H-Pro-Gly-Pro-OBzl.

5.358 g (11.65 mmol) of Boc-Pro-Gly-Pro-OBzl were dissolved in 29.13 ml of methylene chloride; then, 29.13 mL of TFA were added, incubated for 45 minutes at room temperature, evaporated 2 times with absolute ethanol, 2 times with benzene, 2 times with ether and dissolved in benzene; then, hexane was poured over. Hexane was decanted, and the resulted substance was dried under vacuum in a desiccator over KOH, P$_2$O$_5$ and paraffin, while desiccant was changed several times.
Yield: 4.63 g (9.7 mmol) 98%
Rf–0.043 (7); 0.247 (8); 0.018 (9).

V. Boc-Ar(NO2)-Pro-Gly-Pro-OBzl.

3.09 g of Boc-Arg (NO$_2$)—OH (9.7 mmol) were dissolved in 50 mL of THF and 10 ml DMF, 2.07 g (10.67 mmol) of DCC were added, cooled down to 0° C., stirred for 40 minutes; then, a solution of TFA.H-Pro-Gly-Pro-OBzl was added to 50 ml of THF and 4.46 ml (9.7 mmol) of TEA. The reaction mixture was stirred for three days. DCM precipitate was filtered off; the solution was evaporated under vacuum; then, 200 ml of hexane were added to the residue. With this, the desired product was separated as an oil, which was dissolved in 500 mL of ethyl acetate and washed 3 times with 25 ml of 0.1N HCl, three times with 25 ml of H$_2$O, and once with saturated solution of NaCl. The organic layer was dried over MgSO$_4$, filtered and evaporated. The residue was dissolved in ethyl acetate and precipitated with dry ether. The precipitate was filtered and dried under vacuum over P$_2$O$_5$/KOH and paraffin, while desiccant was changed several times.
Yield: 4.76 g (7.9 mmol) 85%
Rf–0.44 (1); 0.8 (11)
Melting point 108-110° C.
[α]$_D^{22}$=–77.8° (c=0.5; CH$_3$COOH).

VI. Boc-Arg-Pro-Gly-Pro.

4.76 g (6.5 mmol) of Boc-Arg(NO$_2$)-Pro-Gly-Pro-OBzl were dissolved in 100 ml of methanol; then 1 ml 1N hydrochloric acid and 4.67 g of catalyst, viz. 10% palladium oxide on neutral aluminum oxide, were added, and hydrogenation in the stream of dry hydrogen at room temperature under 1 atm. was conducted for 6 hours. Then, the catalyst was filtered off and washed on the filter with methanol. Pooled filtrate was evaporated to dryness. The residue was precipitated with ether from the absolute methanol. Then, it was dried under vacuum, while desiccant was changed several times.
Yield: 4.23 g (5.8 mmol) 89%
Rf–0.125 (4); 0.57 (6); 0.37 (5)
Melting point 123-125° C.

VII. Arg-Pro-Gly-Pro.

4.23 g (5.8 mmol) of Boc-Arg-Pro-Gly-Pro-OH were suspended in 10 ml of 2N hydrochloric acid in dioxane and incubated at room temperature for 45 min. Then, dry ether was added, and the precipitate was washed by decantation with dry ether. It was reprecipitated with ether from absolute methanol. The resulting precipitate was dissolved in 7.5 ml of 30% ethanol and applied to Amberlyst A-21 (AcO$^-$ form) column for acetate/hydrochloride salt exchange. Peptide was eluted with 200 ml of 30% ethanol, evaporated to dryness under vacuum and precipitated with absolute ether from methanol.
Yield: 3.69 g (4.93 mmol) 85%
Rf–0.287 (4); 0.145 (5); 0.338 (14)
Melting point 120-122° C.
HPLC results: Column: Supercosil ABZ Plus, size 4.6×250 mm; flow rate 1 mL/min; Eluent A: NH$_4$H$_2$PO$_4$+H$_3$PO$_4$ (50 mM, pH 2.8); eluent B: MeOH
Gradient: 0-20 min (0-40% B); retention time 21.21 min.
Rf–0.24 (6)
Melting point=151° C.
[α]$_D^{22}$=–65.0° (c=0.5 CH$_3$COOH)
HPLC results: Column: Zorbax ODS d=4.6 mm; t=35° C.
Flow rate 1 mL/min; A=50 mM NH$_4$H$_2$PO$_4$ (pH 2.5); B=A+ MeOH (1:1); 10-60% B (in 25 min).
Retention time 16.5 min.

Example 2

Synthesis of Pro-Arg-Pro-Gly-Pro Pentapeptide

Peptide synthesis was performed by classical methods of peptide chemistry using natural L-amino acids according to the diagram shown in FIG. 2.

First, Pro-Gly-Pro tripeptide was produced; then, pentapeptide was obtained by stepwise buildup of the peptide chain from the N-terminus. In synthesis, mixed anhydride method, azide method and carbodiimide method were used.

Chromatographic mobility (Rf) values in the following solvent systems are provided: butanol:acetic acid:water (4:1:1)—(1); chloroform:methanol:ammonia (6:4:1)—(2); acetone:benzene:acetic acid (50:100:1)—(3); chloroform:methanol (9:1)—(4); hexane:acetone (3:2)—(5); butanol:acetic acid:pyridine:water (30:6:20:24)—(6); chloroform:methanol (14:1)—(7).

I. Boc-Pro-Gly-OEt.

8.3 g of Boc-Pro (38.45 mmol) were dissolved in 50 ml of CH$_2$Cl$_2$, cooled down to +5° C., and 38.45 mmol (5.38 ml) of TEA were added. The reaction mixture was cooled down to –25÷–30° C. At this temperature, 38.45 mmol (4.84 ml) of isobutyl chloroformate were added using a pipette. The reaction mixture temperature was kept in the range of –18±–20° C. for 20 minutes. Simultaneously, a solution of 5.9 g (42.3 mmol) of 1.1-fold excess of HCl.H-Gly-OEt in 75 ml of chloroform, containing 5.92 ml of TEA. The solution was cooled down to –25° C. and, after formation of mixed anhydride in the first flask, its contents were poured to the ether solution right away. The reaction mixture was incubated for 1 hour at –10° C. and then stirred for 12 hours at 4° C. on a magnetic stirrer. The reaction mixture was evaporated and 250 ml of ethyl acetate were added to it; the ethyl acetate solution was washed 3 times with 25 ml of 0.1N HCl, 3 times with 25 ml H$_2$O, and once with saturated solution of NaCl. The organic layer was dried over MgSO4, filtered and evaporated. The residue was dried under vacuum over P$_2$O$_5$/KOH and paraffin.
Yield: 10.2 g (30.3 mmol) 78.83%
Rf–0.5 (3); 0.862 (4).

II. Boc-Pro-Gly-N$_2$H$_2$.

10.2 g of Boc-Pro-Gly-OEt (30.3 mmol) were dissolved in 80 ml of absolute methanol, and 4-fold excess of hydrazine hydrate, viz. 5.88 ml (121.2 mmol), was added. The solution was stirred for 12 hours on a magnetic stirrer at room temperature. The reaction mixture was evaporated, then two times evaporated with ether; then, ether (~5 ml) was poured over the residue and left in a refrigerator overnight (for better crystallization, seeding agent was added). The precipitated crystals were filtered, washed with ether using a filter and dried in a desiccator.

Yield: 6.9 g (20.79 mmol) 68.62%

Melting point 98-100° C.

Rf–0.284 (3); 0.474 (4); 0.189 (5).

III. Boc-Pro-Gly-Pro-OBzl.

58.4 mmol (4-fold excess) of hydrogen chloride in ethyl acetate were added to the solution of Boc-Pro-Gly-$N_2H_3$, containing 4.7 g (14.6 mmol) in 40 ml of DMF, cooled down to −20° C., and, immediately, 1.73 mL (14.6 mmol) of freshly distilled tert-butyl nitrite; then, the reaction mixture was stirred for 30 minutes at −5° C. The reaction mixture was cooled down to −40° C., and solution of 8.2 mL (58.4 mmol) of TEA in 4 mL of DMF, cooled down to −10° C., was added; when the temperature of the reaction mixture had risen to −20° C., 3.7 g (15.3 mmol) of 1.05-fold excess of HCl.H-Pro-OBzl were added to 20 ml of DMF and 2.14 ml of TEA. Then, it was stirred at 4° C. for 24 hours on a magnetic stirrer. The reaction mixture was evaporated, and the residue was dissolved in 200 mL of ethyl acetate and washed 2 times with 20 ml of $H_2O$, 3 times with 20 ml of 10% sodium $KHSO_4$, 3 times with 20 ml of $H_2O$, 3 times with 20 ml of 5% $NaHCO_3$, and 3 times with 3 ml of $H_2O$. Ethyl acetate solution was dried over $MgSO_4$. Then it was evaporated, and a small amount of ether (~10 mL) was added to the residue. Then, it was left in a refrigerator. For better product crystallization, seeding agent was added. The precipitated crystals were filtered and washed with a small amount of ether using a filter. Then, they were dried in a desiccator.

Yield: 5.358 g (11.65 mmol) 79.92%

Rf–0.326 (3); 0.947 (4); 0.390 (5)

Melting point 125-126° C.

$[\alpha]_D^{22}=-101.2°$ (c=0.85; $CH_3OH$)

Elemental analysis: C, 62.89 (62.73); N, 9.21 (9.14); H, 7.52 (7.24).

IV. TFA.H-Pro-Gly-Pro-OBzl.

5.358 g (11.65 mmol) of Boc-Pro-Gly-Pro-OBzl were dissolved in 29.13 ml of methylene chloride; 29.13 mL of TFA were added, incubated for 45 minutes at room temperature, evaporated 2 times with absolute ethanol, 2 times with benzene, 2 times with ether and dissolved in benzene; then, hexane was poured over. Hexane was decanted, and the resulted substance was dried under vacuum in a desiccator over $P_2O_5$/KOH and paraffin.

Yield: 4.63 g (9.7 mmol) 98%

Rf–0.043 (3); 0.247 (4); 0.018 (5).

V. Boc-Arg($NO_2$)-Pro-Gly-Pro-OBzl.

3.09 g (9.7 mmol) of Boc-Arg ($NO_2$) were dissolved in 50 ml of THF and 10 ml DMF; then, 2.07 g (10.67 mmol) of DCC were added, cooled down to 0° C. and stirred for 40 minutes; a solution of TFA.H-Pro-Gly-Pro-OBzl was added to 50 ml of THF and 4.46 ml (9.7 mmol) of TEA. The reaction mixture was stirred for three days. DCM precipitate was filtered off; the solution was evaporated under vacuum; then, 200 ml of hexane were added to the residue. With this, the desired product was separated as an oil, which was dissolved in 500 mL of ethyl acetate and washed 3 times with 25 ml of 0.1N HCl, three times with ml of $H_2O$, and once with saturated solution of NaCl. The organic layer was dried over MgSO4, filtered and evaporated. The residue was dried under vacuum over $P_2O_5$/KOH and paraffin.

Yield: 4.76 g (7.9 mmol) 85%

Rf–0.44 (1); 0.8 (6)

Melting point 108-110° C.

VI. TFA-Arg($NO_2$)-Pro-Gly-Pro-OBzl.

4.76 g (7.9 mmol) of Boc-Arg ($NO_2$)-Pro-Gly-Pro-OBzl were dissolved in 20 ml of methylene chloride, 20 mL of TFA were added, incubated for 45 minutes at room temperature, evaporated 2 times with absolute ethanol, 2 times with benzene, 2 times with ether, then dissolved in benzene; then, hexane was poured over. Hexane was decanted, and the resulted substance was dried under vacuum in a desiccator over $P_2O_5$/KOH and paraffin.

The yield is quantitative.

Rf–0.16 (1); 0.27 (6).

VII. BOC-Pro-Arg($NO_2$)-Pro-Gly-OBzl.

1.7 g (7.9 mmol) of Boc-Pro were dissolved in 20 mL of THF, and 1.07 g (7.9 mmol) of BT were added, cooled down to 0° C.; 1.8 g of DCC in 50 ml of THF were added. In 40 min, a solution of TFA-Arg($NO_2$)-Pro-Gly-Pro-OBzl (7.9 mmol) in 50 mL of THF and 1.1 mL (7.9 mmol) of TEA were added to the reaction mixture. It was stirred for 2 hours at 0° C. and for 2 days at room temperature; then, DCM was filtered off, evaporated under vacuum, dissolved in 500 mL of ethyl acetate and treated similarly to Boc-Pro-Arg($NO_2$)-Pro-Gly-Pro-OBzl.

Yield: 4.07 g (67.8%)

Rf–0.42 (1); 0.72 (6); 0.31 (7)

Melting point 147-148° C.

VIII. Boc-Pro-Arg-Pro-Gly-Pro.

4.07 g (6.5 mmol) were dissolved in 100 ml of methanol; 1 ml of 1N hydrochloric acid and 0.85 g of catalyst, viz. 10% palladium oxide on neutral aluminum oxide, were added, and hydrogenation in the stream of dry hydrogen at room temperature under 1 atm. was conducted for 6 hours. Then, the catalyst was filtered off and washed on the filter with methanol. Pooled filtrate was evaporated to dryness. The residue was precipitated with ether from the absolute methanol.

Yield: 3.02 g (5.8 mmol) 89%

Rf–0.125 (1), 0.57 (2), 0.37 (6).

IX. Pro-Arg-Pro-Gly-Pro.

3.02 g (5.8 mmol) of Boc-Pro-Arg-Pro-Gly-Pro were suspended in 10 ml of 2N hydrochloric acid in dioxane and were incubated at room temperature for 45 min. Then, dry ether was added, and the precipitate was washed by decantation with dry ether. It was reprecipitated with ether from absolute methanol. The resulting precipitate was dissolved in 7.5 ml of 30% ethanol and applied to Amberlyst A-21 ($Aco^-$-form) column for acetate/hydrochloride salt exchange. Peptide was eluted with 200 ml of 30% ethanol, evaporated to dryness under vacuum and precipitated with absolute ether from methanol.

Yield: 2.27 g (75%)

Rf–0.2 (2); 0.1 (6)

Melting point 180-185° C.

$[\alpha]_D^{20}=-105°$ (c=0.4; $CH_3COOH$).

Amino acid composition versus arginine: Pro 2.78 (3); Gly 1.1 (1).

HPLC results: Column: Supercosil ABZ Plus, size 4.6×250 mm; flow rate 1 mL/min; Eluent A: $NH_4H_2PO_4+H_3PO_4$ (50 mM, pH 2.8); eluent B: MeOH Gradient: 0-20 min (0-40% B); retention time 10.13 min.

Example 3

Synthesis of Pro-Gly-Pro Tripeptide

The synthesis of Pro-Gly-Pro tripeptide was carried out according to the diagram shown in FIG. 3. Synthesis of Pro- Gly-Pro tripeptide was carried out using modern protecting groups and methods of peptide bond formation in solution. Mixed anhydride method with PivCl was used for peptide bond formation. tert-butyloxycarbonyl protection (Boc) was used for protection of amino groups, and benzyl ester (OBzl) was recruited for protection of carboxyl group. Stepwise approach to peptide chain elongation was used.

Derivatives of L-amino acids were used for synthesis. Evaporation of solutions was conducted using vacuum evaporator at 40° C. Melting points, determined with Boethius apparatus, are given without correction.

Identity of the obtained compounds was tested by TLC on Silufol silica gel-coated plates (Czech Republic). Substances were detected by spraying the plate with a solution of ninhydrin and (or) o-tolidine. Chromatographic mobility (Rf) values in the following solvent systems are provided: (ethyl acetate:acetone:50% acetic acid:water (2:1:1); benzene:ethanol (8:2); chloroform:methanol:ammonia (6:4:1); chloroform:methanol:acetic acid (42:7:1); acetone:benzene:acetic acid (50:100:1); chloroform:methanol (9:1); hexane:acetone (3:2); butanol:acetic acid:water (4:1:1); butanol:acetic acid:pyridine:water (30:6:20:24); hexane:ethyl acetate (4:1); chloroform:methanol:ammonia (8:1.75:0.25); (isopropanol:formic acid:water) (20:5:1); (chloroform:methanol:ammonia) (7:2.5:0.5); methanol. Specific rotation was determined by AI-EPO polarimeter). Elemental analysis using Carlo-Erba model 1106 analyzer.

I. Production of Boc-Pro-Gly-OH.

1. 10.75 g (50 mmol) of Boc-Pro were dissolved in 150 ml of acetonitrile, cooled down to −5° C.; then, 7.7 ml (50 mmol) of triethylamine (TEA) were added to the solution, and it was cooled down to −20° C., while stirring on a magnetic stirrer. 6.8 ml (55 mmol) of pivaloyl chloride (PivCl) were added to the cooled solution, stirred on a magnetic stirrer for 20 minutes at −10° C. and then cooled down to −30° C.; then, precooled solution of Gly was added. Simultaneously, Gly solution was prepared 2. 4.5 g of Gly (60 mmol, 1.2-fold excess) were dissolved in 35 ml of water and 60 ml of acetonitrile, 8.4 ml (60 mmol) of triethylamine were added. The mixture was cooled down to −10° C. and added to the solution in the first flask after 20 minutes. The reaction mixture was incubated for 1 hour at −10° C. and stirred for 2 hours at 18-20° C. on a magnetic stirrer. The reaction mixture was evaporated on a rotary evaporator. About 50 mL of water were added to the residue. The aqueous solution was acidified with a 3-fold excess of NaHSO$_4$ (24.84 g) to pH=3 and extracted 5 times with 100 ml of ethyl acetate. Pooled ethyl acetate solution was washed with H$_2$O (50 mL), 10% solution of KHSO$_4$ (50 mL), H$_2$O (50 mL), and saturated NaCl (50 mL). Ethyl acetate solution was dried over MgSO4. Dried ethyl acetate was filtered and evaporated. Dry ether was added to the residue. Upon the addition of ether to the flask, it precipitated the product, which was filtered and washed with dry ether using a filter. The resulted substance was dried under vacuum in a desiccator over KOH, P2O5 and paraffin, while desiccant was changed several times.

Product M.W. 272.3
Yield: 5.97 g (21.74 mmol); (43.5%)
Melting point 70° C.
Rf−0.863 (acetone-benzene-acetic acid) (50:100:1);
0.746 (benzene-ethanol) (8:2); 0.903 (chloroform:methanol) (9:1);
0.847 (Ethyl acetate:acetone:50% acetic acid:water) (2:1:1).

II. Production of Boc-Pro-Gly-OBzl.

1. 5.97 g (21.74 mmol) of Boc-Pro-Gly-OH were dissolved in 100 ml of acetonitrile, cooled down to −5° C.; then, 1.1- fold excess (3.35 ml, 23.9 mmol) of triethylamine (TEA) was added to the solution, and it was cooled down to −20° C., while stirring on a magnetic stirrer. 1.1-fold excess (2.34 ml, 23.9 mmol) of pivaloyl chloride (PivCl) was added to the cooled solution, stirred on a magnetic stirrer for 20 minutes at −10° C. and then cooled down to −30° C.; then, precooled solution of HCl.Pro-OBzl was added. Simultaneously, HCl.Pro-OBzl was prepared.

2. 6.3 g of HCl.Pro-OBzl (26.1 mmol, 1.2 excess) were dissolved in 50 ml of acetonitrile, 4.0 ml (28.71 mmol; 1.1-fold excess) of triethylamine were added. The mixture was cooled down to −10° C. and added to the solution in the first flask after 20 minutes. The reaction mixture was incubated for 1 hour at −10° C. and stirred for 2 hours at 18-20° C. on a magnetic stirrer. The reaction mixture was evaporated. 300 ml of ethyl acetate were added to the evaporated residue. Ethyl acetate solution was washed with H$_2$O (3 times with 25 mL), 10% solution KHSO$_4$ (3 times with 25 ml) H$_2$O (3 times with 25 ml), 5% NaHCO$_3$ (3 times with 25 ml) H$_2$O (3 times 25 mL), and saturated solution of NaCl (once with 25 mL). Ethyl acetate solution was dried over MgSO$_4$. Dried ethyl acetate was filtered and evaporated. About 100 ml of dry ether were added to the residue. Upon the addition of ether to the flask, it precipitated the product, which was filtered and washed with dry ether using a filter. The resulted substance was dried under vacuum in a desiccator over KOH, P$_2$O$_5$ and paraffin, while desiccant was changed several times.

Product M.W. 459.82
Yield: 8.12 g (17.66 mmol); (81.23%)
Melting point 125-126° C.
Rf−0.326 (acetone:benzene:acetic acid) (50:100:1)
0.390 (hexane:acetone) (3:2)
0.947 (chloroform:methanol) (9:1)
0.716 (methanol)
0.620 (benzene:ethanol) (8:2)

III. Production of Boc-Pro-Gly-Pro-OH.

8 g (17.4 mmol) of Boc-Pro-Gly-Pro-OBzl were dissolved in 100 ml of methanol, 0.5 ml of CH$_3$COOH and palladium black were added, while stirring on a magnetic stirrer, and hydrogen was passed through for 2 hours. The solution was filtered, evaporated, evaporated 3 times with benzene and 2 times with ethyl acetate. Then, it was precipitated with ether hexane from acetone, and the precipitate formed in the flask was dried in a desiccator over P$_2$O$_5$/KOH and paraffin.

Product M.W. 369.39
Yield: 6.3 g (17.05 mmol) 98%
Melting point 99-100° C.
Rf: 0.560 (chloroform-methanol) (9:1)
0.812 (chloroform-methanol-acetic acid) (42:7:1)
0.187 (acetone:benzene:acetic acid) (50:100:1)
0.164 (hexane:acetone) (3:2)

IV. Production of Pro-Gly-Pro.

40.6 ml of methylene chloride and 40.6 ml of TFA were added to 6.0 g (16.24 mmol) of Boc-Pro-Gly-Pro-OH and incubated for 45 minutes at room temperature; after removal of the protecting group, the solution was evaporated 2 times with absolute methanol, 2 times with benzene and 2 times with ether. It was precipitated with ether from acetone. The residue was dried under vacuum over P$_2$O$_5$, KOH and paraffin. The dried product was reprecipitated with dry diethyl ether from absolute MeOH.

Product M.W. 381.39
Yield: 5.6 g (14.72 mmol) (90.62%)

The resulting precipitate of TFA.Pro-Gly-Pro-OH was dissolved in 10 ml of 30% ethanol; then, 25 mL of Amberlyst A-21 (CH$_3$COO$^-$) ion-exchange resin was added for exchange of trifluoroacetate to acetate salt and stirred on a magnetic stirrer for 45 minutes; then, it was washed with 150 ml of 30% ethanol, evaporated to dryness under vacuum and precipitated with dry diethyl ether from absolute methanol. The resulting precipitate was filtered off and dried in a desiccator under vacuum over $P_2O_5$, KOH and paraffin, while desiccant was changed several times.

Product M.W. 328.34
Yield: 4.54 g (13.84 mmol) (94%)
Melting point 143-145° C.
$[\alpha]_D^{22}$ –31.5° (c 1, MeOH)
Rf: 0.59 (chloroform:methanol:ammonia) (6:4:1)
0.52 (chloroform:methanol:ammonia) (4:4.5:1.5)
0.524 (ethanol:ammonia) (7:3)

Example 4

Synthesis of Thr-Lys-Pro-Arg-Pro-Phe Hexapeptide

Synthesis of Thr-Lys-Pro-Arg-Pro-Phe hexapeptide was performed according to the diagram shown in FIG. 4.

Synthesis of Thr-Lys-Pro-Arg-Pro-Phe hexapeptide was carried out using modern protecting groups and methods of peptide bond formation in solution. TBA salt method, activated ester method, carbodiimide method and mixed anhydride method were used for peptide bond formation. Both stepwise and blockwise approaches were used.

Example 5

Synthesis of Thr-Lys-Pro-Arg-Pro Pentapeptide

Figure 5:
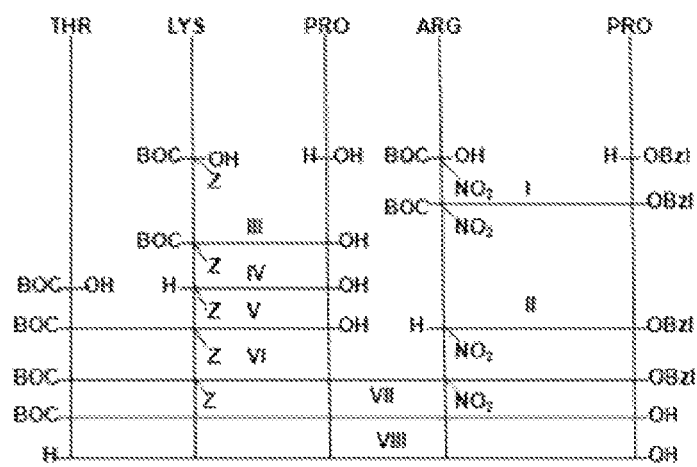
FIG. 5 shows a diagram of Thr-Lys-Pro-Arg-Pro (SEQ ID NO: 6) pentapeptide synthesis.

Synthesis of Thr-Lys-Pro-Arg-Pro pentapeptide was performed according to the diagram shown in FIG. 5.

Synthesis of Thr-Lys-Pro-Arg-Pro pentapeptide was carried out using modern protecting groups and methods of peptide bond formation in solution. TBA salt method, activated ester method and carbodiimide method were used for peptide bond formation. Both stepwise and blockwise approaches were used.

Example 6

Synthesis of Thr-Lys Dipeptide

Figure 6:
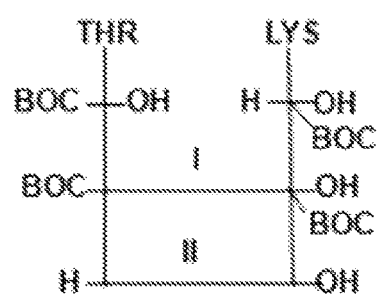
FIG. 6 shows a diagram of Thr-Lys (SEQ ID NO: 2678) dipeptide synthesis.

Synthesis of Thr-Lys dipeptide was performed according to the diagram shown in FIG. 6.

Synthesis of Thr-Lys dipeptide was carried out using modern protecting groups and methods of peptide bond formation in solution. TBA salt method, was used for peptide bond formation.

Derivatives of both protected and free L-amino acids were used for synthesis of the peptides described in Examples 7-9. The solvents used in peptide synthesis, were correspondingly absolutized. Peptide homogeneity was tested by high performance liquid chromatography (HPLC) using Millichrome A-02 microcolumn liquid chromatographic system. The synthesized peptides were characterized by mass spectrometry using Bruker mass spectrometer (®Bruker Daltonik GmbH).

Example 7

Synthesis of Thr-Lys-Pro-Phe Tetrapeptide

Figure 7:
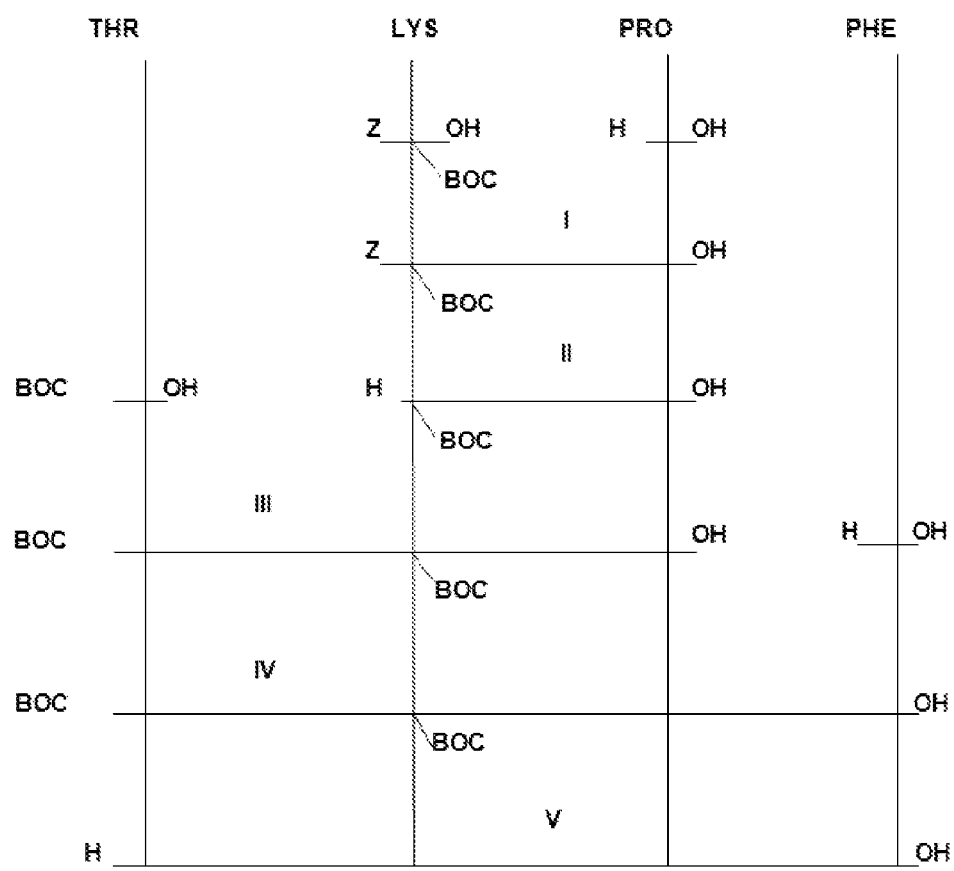
FIG. 7 shows a diagram of Thr-Lys-Pro-Phe (SEQ ID NO: 2679) tetrapeptide synthesis.

The synthesis of Thr-Lys-Pro-Phe tetrapeptide was carried out according to the diagram shown in FIG. 7.

Synthesis of Thr-Lys-Pro-Phe tetrapeptide was carried out using modern protecting groups and methods of peptide bond formation in solution. TBA salt method and activated ester method were used for peptide bond formation. Stepwise approach to peptide chain elongation was used.

Derivatives of both protected and free L-amino acids were used for synthesis. Evaporation of solutions was conducted using vacuum evaporator at 40° C. Melting points, determined with Boethius apparatus, are given without correction. Identity of the obtained compounds was tested by TLC on Silufol silica gel-coated plates (Czech Republic). Substances were detected by spraying the plate with a solution of ninhydrin and (or) o-tolidine. Chromatographic mobility (Rf) values in the following solvent systems are provided: (butanol:acetic acid:water) (4:1:1); (benzene-ethanol) (8:2); (chloroform:methanol) (9:1); (isopropanol:formic acid:water) (20:5:1); (chloroform-methanol-acetic acid) (42:7:1); (chloroform:methanol:ammonia) (8:1.75:0.25); (acetone-benzene-acetic acid) (50:100:1); (chloroform:methanol:ammonia) (6:4:1); (chloroform:methanol:ammonia) (44.5:1.5); (butanol:acetic acid:pyridine:water) (30:6:20:24).

I. Production of Z-Lys(Boc)-Pro-OH.

13% solution of TBA (98 ml) was added to 46.32 mmol (5.34 g) of Pro and evaporated two times with ethanol, two times with ethanol/benzene mixture, and 2 times with benzene. 300 ml of absolute ethyl acetate were added; the reaction mixture was cooled down to 0° C., and 23.16 mmol (12.66 g) of previously synthesized Z-Lys (Boc)-OPfp were added and stirred on a magnetic stirrer for 1 hour. The reaction mass was evaporated, and 40 ml of water were added to the evaporation residue. The aqueous solution was washed 3 times with 80 ml of ether. After washing with ether, the aqueous solution was acidified with citric acid to pH 3. After acidification, aqueous solution was extracted with ethyl acetate 3 times in 40 ml aliquots. Pooled ethyl acetate after extraction was washed 3 times with 20 ml of water, 3 times with 20 ml of 10% solution of $KHSO_4$, and 3 times with 20 ml of water. Ethyl acetate solution was dried over $MgSO_4$. Then, it was filtered and evaporated on a rotary evaporator. The resulted substance was precipitated with hexane from ethyl acetate. Hexane was decanted, and the resulted substance was dried under vacuum in a desiccator over KOH, $P_2O_5$ and paraffin, repeatedly changing desiccant.

Yield: 9.68 g (20.26 mmol); (87.51%).
Melting point 76-77° C.
Rf–0.705 (butanol:acetic acid:water) (4:1:1);
0.560 (benzene-ethanol) (8:2);
0.476 (chloroform:methanol) (9:1);
0.813 (isopropanol:formic acid:water) (20:5:1);
0.297 (acetone-benzene-acetic acid) (50:100:1).

I. Production of H-Lys(Boc)-Pro-OH.

300 ml of absolute methanol, 2 ml of acetic acid, and palladium black were added to 9.68 g (20.26 mmol) of Z-Lys (Boc)-Pro-OH, and hydrogenation was performed in the stream of dry hydrogen at room temperature under 1 atm for 8 hours. Then, the catalyst was filtered off and washed on the filter with methanol. Pooled filtrate was evaporated to dryness. The residue was precipitated with ether from the absolute methanol. Then, it was dried under vacuum, while desiccant was changed several times.

Yield: 6.38 g (18.58 mmol); (91.87%)
Melting point 98-99° C.
Rf–0.110 (chloroform-methanol-acetic acid) (42:7:1);
0.166 (butanol:acetic acid:water) (4:1:1);
0.235 (chloroform:methanol:ammonia) (8:1.75:0.25);
0.494 (isopropanol:formic acid:water) (20:5:1) (2:1:1).

III. Production of Boc-Thr-Lys-Boc)-Pro-OH.

13% solution of TBA (39.4 ml) was added to 18.58 mmol (6.38 g) of Lys (Boc)-Pro-OH and evaporated 2 times with ethanol, 2 times with ethanol/benzene mixture and 2 times with benzene. 250 ml of absolute ethyl acetate were added; the reaction mixture was cooled down to 0° C., and 9.2 mmol (3.74 g) of previously synthesized Boc-Thr-OPfp were added and stirred on a magnetic stirrer for 1 hour. The reaction mass was evaporated, and 40 ml of water were added to the evaporation residue. The aqueous solution was washed 3 times with 80 ml of ether. After washing with ether, the aqueous solution was acidified with 18.58 mmol (3.95 g) of citric acid to pH 3. After acidification, aqueous solution was extracted with ethyl acetate 3 times in 40 ml aliquots. Pooled ethyl acetate after extraction was washed 3 times with 20 ml of water, 3 times with 20 ml of 10% solution of $KHSO_4$, and 3 times with 20 ml of water. Ethyl acetate solution was dried over $MgSO_4$.

Then, it was filtered and evaporated on a rotary evaporator. The resulted substance was precipitated with hexane from ethyl acetate. Hexane was decanted, and the resulted substance was dried under vacuum in a desiccator over KOH, $P_2O_5$ and paraffin, while desiccant was changed several times.
Yield: 3.32 g (6.1 mmol); (66.26%) Melting point 105-107° C.
Rf–0.297 (acetone-benzene-acetic acid) (50:100:1);
0.234 (chloroform:methanol) (9:1); 0.560 (benzene-ethanol) (8:2).

IV. Production of Boc-Thr-Lys(Boc)-Pro-Phe-OH.
  1. Production of Boc-Thr-Lys(Boc)-Pro-OSu.
  3.53 mmol (0.38 g) of hydroxysuccinimide were added to 1.66 g (3.05 mmol) of Boc-Thr-Lys(Boc)-Pro in 50 ml of absolute ethyl acetate, and the resulting solution was cooled down to 0° C., while stirring on a magnetic stirrer; then, 0.76 g (3.53 mmol) DCC (dicyclohexylcarbodiimide) were added and stirred on a magnetic stirrer at room temperature for 2 hours. After reaction stopped, the resulting reaction mixture was filtered off and the precipitate was discarded. 200 ml of absolute ethyl acetate were added to the resulting solution. Pooled ethyl acetate was washed 2 times with 20 ml of saturated solution of NaCl, two times with 20 ml of 10% sodium $KHSO_4$, 2 times with 20 ml of saturated solution of NaCl, 2 times with 20 ml of 5% $NaHCO_3$, and 2 times with 20 ml of saturated solution of NaCl. Ethyl acetate solution was dried over $MgSO_4$. Then, it was filtered and evaporated on a rotary evaporator. The resulted substance was precipitated with ether and hexane from ethyl acetate. The precipitate was filtered and dried under vacuum over KOH, $P_2O_5$ and paraffin, while desiccant was changed several times.
Yield: 1.52 g (2.37 mmol) 77.74%.
Rf–0.560 (benzene-ethanol) (8:2); 0.457 (chloroform:methanol) (9:1).

2. After preparation, 1.52 g (2.37 mmol) of Boc-Thr-Lys (Boc)-Pro-OSu were dissolved in 25 ml of dimethylformamide and added to the prepared solution, containing 0.392 g (2.37 mmol) of L-Phe in 25 ml of dimethylformamide. The solution was stirred on a magnetic stirrer at room temperature. The reaction mixture was evaporated on a rotary evaporator and precipitated with ether from benzene. The precipitate was filtered and dried under vacuum over $P_2O_5$/KOH and paraffin, while desiccant was changed several times.
Yield: 1.03 g (1.64 mmol) 69.0%.
Rf–0.063 (isopropanol:formic acid:water) (20:5:1) (2:1:1).
0.745 (chloroform:methanol:ammonia) (8:1.75:0.25);

V. Production of H-Thr-Lys-Pro-Phe-OH.
  1.03 g (1.64 mmol) of Boc-Thr-Lys (Boc)-Pro-Phe-OH were added to 8.2 mL of methylene chloride and 8.2 ml of TFA, then the mixture was incubated for 45 minutes at room temperature, and, after removal of protecting groups, the solution was evaporated 2 times with absolute methanol, 2 times with benzene, and 2 times with ether. It was precipitated with ether from methanol. The residue was dried under vacuum over $P_2O_5$, KOH and paraffin. The resulting precipitate was dissolved in 5 ml of 30% ethanol and applied to Amberlyst A-21 ($AcO^-$-form) column for acetate/hydrochloride salt exchange. Peptide was eluted with 100 ml of 30% ethanol, evaporated to dryness under vacuum and precipitated with absolute ether from absolute methanol. The resulting precipitate was filtered and dried in a desiccator under vacuum over $P_2O_5$, KOH and paraffin, while desiccant was changed several times.
Yield: 0.7 g (1.43 mmol) (87%).
Melting point 129-131° C.
Rf: –0.201 (butanol:acetic acid:pyridine:water) (30:6:20:24);
0.156 (chloroform:methanol:ammonia) (4:4.5:1.5).

Chromatographic and mass spectrometric analysis of peptide sequences, described in Examples 1-7, is shown in Table 2.

TABLE 2

| No | Peptide | SEQ ID NO | MW | Chromatographic characteristics Tr, min | Purity, % | $*[M + H]^+$ | Mass spectrometric characteristics Fragmentation of the molecular ion peak** |
|---|---|---|---|---|---|---|---|
| 1 | Thr-Lys-Pro-Arg-Pro | 6 | 597 | 8.01 | 97 | 598 | 369(100), 272(31), 580(29) |
| 2 | Thr-Lys-Pro-Arg-Pro-Phe | 7 | 744 | 14.8 | 96 | 745 | 516(100)0.263(59), 327(38) |
| 3 | Pro-Arg-Pro-Gly-Pro | 2675 | 522 | 9.14 | 89 | 523 | 25(100)0.425(27), 407(11) |
| 4 | Thr-Lys-Pro-Arg | 4 | 500 | 5.72 | 94 | 501 | 457(100)0.272(55), 484(47), |
| 5 | Arg-Pro-Gly-Pro | 2676 | 425 | 6.82 | 85 | 426 | 408(100), 293(54), 254(24) |
| 6 | Pro-Gly-Pro | 2677 | 269 | 5.42 | >98 | 270 | 173(100), 155(98), 116(75) |

TABLE 2-continued

| No | Peptide | SEQ ID NO | MW | Chromatographic characteristics Tr, min | Purity, % | *[M + H]⁺ | Mass spectrometric characteristics Fragmentation of the molecular ion peak** |
|---|---|---|---|---|---|---|---|
| 7 | Thr-Lys-Pro | 5 | 344 | 4.15 | 93 | 345 | 230(100), 129(19), 212(16) |
| 8 | Thr-Lys | 2678 | 247 | 1.77 | 95 | 248 | 230(100), 129(78), 84(30) |
| 9 | Thr-Lys-Pro-Phe | 2679 | 500 | 5.72 | 94 | 501 | 457(100) 0.272(55), 484(47) |

Note.
*Molecular peak corresponding to [M + H]⁺
**Most intense ions formed in the fragmentation of the molecular ion peak at the energy of collisions with helium atoms of 35 eV.

Table 2 shows the data of high performance liquid chromatography (HPLC) using Millichrome A-02 microcolumn liquid chromatographic system and mass spectrometric characteristics of synthesized peptides obtained using Thermo-Electron LCQ Advantage MAX mass spectrometer.

Developed chromatographic conditions allow to easily obtain chromatographically homogeneous product.

Chromatographic conditions for analysis of peptides.
Chromatograph: Milichrom-A02
Column: Prontosil 120-5C18aq, 2*75 mm
Eluent A: 0.2M LiClO4+5 mM HClO$_4$
eluent B: methanol.

Table 3 presents gradient shape for separation of the synthesized peptides.

TABLE 3

| Time | % B |
|---|---|
| 0 | 5 |
| 16.5 | 80 |

Flow rate: 150 μl/min
Set of wavelengths: 210, 220, 230, 240 nm
Mass Spectrometry Conditions
Equipment: ThermoElectron LCQ Advantage MAX
Ion source: electrospray; direct introduction of peptide solution with a concentration of 10 μg/ml in 0.1% acetic acid at a flow rate of 5 μl/min Molecular ion fragmentation at 35 eV by ion collisions (He)

Source temperature: 250° C.
Ionization potential 3.5 kV

Example 8

Identification of Pharmacophore Position

To identify pharmacophore, fragments of the parent peptide Selank were synthesized: Thr-Lys; Thr-Lys-Pro; Pro-Gly-Pro; Arg-Pro-Gly-Pro; Pro-Arg-Pro-Gly-Pro; and efficacy tests were conducted in vivo using relevant pre-clinical model (Lordosis test).

We studied the efficacy of the following group of peptides: Thr-Lys; Thr-Lys-Pro; Pro-Gly-Pro; Arg-Pro-Gly-Pro; Pro-Arg-Pro-Gly-Pro in the dose of 100 μg/rat in relation to sexual behavior of female rats. Sexual behavior was recorded in ovariectomized hormonally stimulated females in direct contact with the sexually active male, or when such a contact was impossible. It was found that Thr-Lys-Pro peptide increased the intensity of proceptive behavior in females from 14±4 to 29±6 acts during monitoring (p=0.028, Wilcoxon test). The effect on the lordosis reaction in females had the same trend (p=0.09): the number of lordoses under the action of Thr-Lys-Pro peptide increased from 0.73±0.12 to 0.97±0.12. These results indicate the intensification of sexual motivation on the background of Thr-Lys-Pro peptide action. The effect is specific and manifested in an adequate behavioral situation. Results of efficacy studies of the following peptides: Thr-Lys; Thr-Lys-Pro; Pro-Gly-Pro; Arg-Pro-Gly-Pro; and Pro-Arg-Pro-Gly-Pro; in the model of lordosis are shown in Table 4

TABLE 4

| Group | SEQ ID NO | Progesterone, mg/rat | Test product, μg/rat | Number of acts of proceptive behavior | Percentage of lordoses |
|---|---|---|---|---|---|
| Negative Control | | 0.5 | 0 | 14 ± 4 | 0.73 ± 0.12 |
| Thr-Lys | 2678 | 0.5 | 100 | 13 ± 4 | 0.70 ± 0.02 |

TABLE 4-continued

| Group | SEQ ID NO | Progesterone, mg/rat | Test product, μg/rat | Number of acts of proceptive behavior | Percentage of lordoses |
|---|---|---|---|---|---|
| Thr-Lys-Pro | 5 | 0.5 | 100 | 29 ± 6 | 0.97 ± 0.12 |
| Pro-Gly-Pro | 2677 | 0.5 | 100 | 13 ± 5 | 0.74 ± 0.09 |
| Arg-Pro-Gly-Pro | 2676 | 0.5 | 100 | 15 ± 4 | 0.69 ± 0.14 |
| Pro-Arg-Pro-Gly-Pro | 2675 | 0.5 | 100 | 14 ± 6 | 0.73 ± 0.14 |
| Positive Control | | 1.0 | 0 | 22 ± 11 | 0.98 ± 0.09 |

Table 4 proves that Thr-Lys-Pro tripeptide is the pharmacophore; furthermore, the smaller sequence, i.e. Thr-Lys dipeptide, does not function, as results from the Table 4.

Example 9

Pharmacophore Test

To test the pharmacophore, peptides based on it were synthesized, viz. Thr-Lys-Pro tripeptide, Thr-Lys-Pro-Arg (SEQ ID NO: 4) and Thr-Lys-Pro-Phe (SEQ ID NO: 2679) tetrapeptides, Thr-Lys-Pro-Arg-Pro (SEQ ID NO: 6) pentapeptide, and Thr-Lys-Pro-Arg-Pro-Phe (SEQ ID NO: 7) hexapeptide, corresponding to the general formula A-Thr-Lys-Pro-B-C-D-X, efficacy test were conducted on the in vivo, using relevant pre-clinical models (lordosis test).

We studied the efficacy of the following group of peptides: Thr-Lys-Pro (SEQ ID NO: 5); Thr-Lys-Pro-Arg (SEQ ID NO: 4); Thr-Lys-Pro-Arg-Pro (SEQ ID NO: 6); and Thr-Lys-Pro-Arg-Pro-Phe (SEQ ID NO: 7); at a dose of 100 μg/rat in relation to sexual behavior of female rats. Sexual behavior was recorded in ovariectomized hormonally stimulated females in direct contact with the sexually active male, or when such a contact was impossible. It was found that peptides from the group, including Thr-Lys-Pro (SEQ ID NO: 5), Thr-Lys-Pro-Arg-Pro (SEQ ID NO: 6), and Thr-Lys-Pro-Arg-Pro-Phe (SEQ ID NO: 7), increased the intensity of proceptive behavior in females from 14±4 to 26±4-36±6 acts during monitoring (p=0.028, Wilcoxon test). At the same time, Thr-Lys-Pro-Arg (SEQ ID NO: 4) and Thr-Lys-Pro-Phe (SEQ ID NO: 2679) do not affect the intensity of proceptive behavior of females and do not increase the number of lordoses, and the basic parameters of Thr-Lys-Pro-Arg (SEQ ID NO: 4) and Thr-Lys-Pro-Phe (SEQ ID NO: 2679) tetrapeptides remain at the level of negative control. The effect on the lordosis reaction in females had the same trend (p=0.09). In the absence of direct contact of partners, peptide action was manifested. The results indicate the intensification of sexual motivation on the background of Thr-Lys-Pro (SEQ ID NO: 5), Thr-Lys-Pro-Arg-Pro (SEQ ID NO: 6), Thr-Lys-Pro-Arg-Pro-Phe (SEQ ID NO: 7) peptide action and lack of sexual motivation effect in Thr-Lys-Pro-Arg (SEQ ID NO: 4) and Thr-Lys-Pro-Phe (SEQ ID NO: 2679) tetrapeptides. The effect is specific and manifested in an adequate behavioral situation. Results of efficacy studies of the following peptides: Thr-Lys-Pro; Thr-Lys-Pro-Arg (SEQ ID NO: 4); Thr-Lys-Pro-Phe (SEQ ID NO: 2679); Thr-Lys-Pro-Arg-Pro (SEQ ID NO: 6); Thr-Lys-Pro-Arg-Pro-Phe (SEQ ID NO: 7); in the model of lordosis are shown in Table 5.

TABLE 5

| Group | SEQ ID NO | Progesterone mg/rat | Test product, μg/rat | Number of acts of proceptive behavior | Percentage of lordoses |
|---|---|---|---|---|---|
| Negative Control | | 0.5 | 0 | 14 ± 4 | 0.73 ± 0.12 |
| Thr-Lys-Pro | 5 | 0.5 | 100 | 28 ± 4 | 0.96 ± 0.12 |
| Thr-Lys-Pro-Arg | 4 | 0.5 | 100 | 14 ± 4 | 0.72 ± 0.02 |
| Thr-Lys-Pro-Phe | 2679 | 0.5 | 100 | 13 ± 5 | 0.73 ± 0.09 |
| Thr-Lys-Pro-Arg-Pro | 6 | 0.5 | 100 | 36 ± 6 | 0.99 ± 0.09 |
| Thr-Lys-Pro-Arg-Pro-Phe | 7 | 0.5 | 100 | 26 ± 4 | 0.94 ± 0.14 |
| Positive Control | | 1.0 | 0 | 22 ± 11 | 0.98 + 0.09 |

INDUSTRIAL APPLICABILITY

The invention relates to the field of biochemistry, in particular, to a method for producing peptides exhibiting high activity and capable of stimulating self-healing in the organs where a disturbance occurred. In particular, the invention allows to expand the range of tools for stimulation of sexual function and treatment of sexual dysfunction, while reducing the duration of course therapy and the costs of medications.

SEQUENCE LISTING (2680 sequences)

SEQ ID NO: 1 - protein, 5 aa, Artificial Sequence
  Description of Artificial Sequence: Synthetic peptide
FTKPG

SEQ ID NO: 2 - protein, 5 aa, Artificial Sequence
  Description of Artificial Sequence: Synthetic peptide
TKPPR

SEQ ID NO: 3 - protein, 5 aa, Artificial Sequence
  Description of Artificial Sequence: Synthetic peptide
TKPRG

SEQ ID NO: 4 - protein, 4 aa, Artificial Sequence
  Description of Artificial Sequence: Synthetic peptide
TKPR

SEQ ID NO: 5 - protein, 3 aa, Artificial Sequence
  Description of Artificial Sequence: Synthetic peptide
TKP

SEQ ID NO: 6 - protein, 5 aa, Artificial Sequence
  Description of Artificial Sequence: Synthetic peptide
TKPRP

SEQ ID NO: 7 - protein, 6 aa, Artificial Sequence
  Description of Artificial Sequence: Synthetic peptide
TKPRPF

SEQ ID NO: 8 - protein, 5 aa, Artificial Sequence
  Description of Artificial Sequence: Synthetic peptide
TKPRH

SEQ ID NO: 9 - protein, 5 aa, Artificial Sequence
  Description of Artificial Sequence: Synthetic peptide
TKPFH

SEQ ID NO: 10 - protein, 5 aa, Artificial Sequence
  Description of Artificial Sequence: Synthetic peptide
TKPYH

SEQ ID NO: 11 - protein, 5 aa, Artificial Sequence
  Description of Artificial Sequence: Synthetic peptide
TKPGH

SEQ ID NO: 12 - protein, 5 aa, Artificial Sequence
  Description of Artificial Sequence: Synthetic peptide
TKPHH

SEQ ID NO: 13 - protein, 5 aa, Artificial Sequence
  Description of Artificial Sequence: Synthetic peptide
TKPKH

SEQ ID NO: 14 - protein, 5 aa, Artificial Sequence
  Description of Artificial Sequence: Synthetic peptide
TKPGH

SEQ ID NO: 15 - protein, 6 aa, Artificial Sequence
  Description of Artificial Sequence: Synthetic peptide
TKPGRH

SEQ ID NO: 16 - protein, 6 aa, Artificial Sequence
  Description of Artificial Sequence: Synthetic peptide
TKPGFH

SEQ ID NO: 17 - protein, 6 aa, Artificial Sequence
  Description of Artificial Sequence: Synthetic peptide
TKPGYH

SEQ ID NO: 18 - protein, 6 aa, Artificial Sequence
  Description of Artificial Sequence: Synthetic peptide
TKPGHH

SEQ ID NO: 19 - protein, 6 aa, Artificial Sequence
  Description of Artificial Sequence: Synthetic peptide
TKPGPH

SEQ ID NO: 20 - protein, 6 aa, Artificial Sequence
  Description of Artificial Sequence: Synthetic peptide
TKPGKH

SEQ ID NO: 21 - protein, 5 aa, Artificial Sequence
  Description of Artificial Sequence: Synthetic peptide
TKPDH

SEQ ID NO: 22 - protein, 6 aa, Artificial Sequence
  Description of Artificial Sequence: Synthetic peptide
TKPDRH

SEQ ID NO: 23 - protein, 6 aa, Artificial Sequence
  Description of Artificial Sequence: Synthetic peptide
TKPDFH

SEQ ID NO: 24 - protein, 6 aa, Artificial Sequence
  Description of Artificial Sequence: Synthetic peptide
TKPDYH

SEQ ID NO: 25 - protein, 6 aa, Artificial Sequence
  Description of Artificial Sequence: Synthetic peptide
TKPDHH

SEQ ID NO: 26 - protein, 6 aa, Artificial Sequence
  Description of Artificial Sequence: Synthetic peptide
TKPDPH

SEQ ID NO: 27 - protein, 6 aa, Artificial Sequence
  Description of Artificial Sequence: Synthetic peptide
TKPDKH

SEQ ID NO: 28 - protein, 5 aa, Artificial Sequence
  Description of Artificial Sequence: Synthetic peptide
TKPWH

SEQ ID NO: 29 - protein, 6 aa, Artificial Sequence
  Description of Artificial Sequence: Synthetic peptide
TKPWRH

SEQ ID NO: 30 - protein, 6 aa, Artificial Sequence
  Description of Artificial Sequence: Synthetic peptide
TKPWFH

SEQ ID NO: 31 - protein, 6 aa, Artificial Sequence
  Description of Artificial Sequence: Synthetic peptide
TKPWYH

SEQ ID NO: 32 - protein, 6 aa, Artificial Sequence
  Description of Artificial Sequence: Synthetic peptide
TKPWHH

SEQ ID NO: 33 - protein, 6 aa, Artificial Sequence
  Description of Artificial Sequence: Synthetic peptide
TKPWPH

SEQ ID NO: 34 - protein, 6 aa, Artificial Sequence
  Description of Artificial Sequence: Synthetic peptide
TKPWKH

SEQ ID NO: 35 - protein, 5 aa, Artificial Sequence
  Description of Artificial Sequence: Synthetic peptide
TKPQH

SEQ ID NO: 36 - protein, 6 aa, Artificial Sequence
  Description of Artificial Sequence: Synthetic peptide
TKPQRH

SEQ ID NO: 37 - protein, 6 aa, Artificial Sequence
  Description of Artificial Sequence: Synthetic peptide
TKPQFH

SEQ ID NO: 38 - protein, 6 aa, Artificial Sequence
  Description of Artificial Sequence: Synthetic peptide
TKPQYH

SEQ ID NO: 39 - protein, 6 aa, Artificial Sequence
  Description of Artificial Sequence: Synthetic peptide
TKPQHH

SEQ ID NO: 40 - protein, 6 aa, Artificial Sequence
  Description of Artificial Sequence: Synthetic peptide
TKPQPH

SEQ ID NO: 41 - protein, 6 aa, Artificial Sequence
  Description of Artificial Sequence: Synthetic peptide
TKPQKH

SEQ ID NO: 42 - protein, 5 aa, Artificial Sequence
  Description of Artificial Sequence: Synthetic peptide
TKPNH

SEQ ID NO: 43 - protein, 6 aa, Artificial Sequence
  Description of Artificial Sequence: Synthetic peptide
TKPNRH

SEQ ID NO: 44 - protein, 6 aa, Artificial Sequence
  Description of Artificial Sequence: Synthetic peptide
TKPNFH

SEQ ID NO: 45 - protein, 6 aa, Artificial Sequence
  Description of Artificial Sequence: Synthetic peptide
TKPNYH

SEQ ID NO: 46 - protein, 6 aa, Artificial Sequence
  Description of Artificial Sequence: Synthetic peptide
TKPNHH

SEQ ID NO: 47 - protein, 6 aa, Artificial Sequence
  Description of Artificial Sequence: Synthetic peptide
TKPNPH

SEQ ID NO: 48 - protein, 6 aa, Artificial Sequence
  Description of Artificial Sequence: Synthetic peptide
TKPNKH

SEQ ID NO: 49 - protein, 5 aa, Artificial Sequence
  Description of Artificial Sequence: Synthetic peptide
TKPYH

SEQ ID NO: 50 - protein, 6 aa, Artificial Sequence
  Description of Artificial Sequence: Synthetic peptide
TKPYRH

SEQ ID NO: 51 - protein, 6 aa, Artificial Sequence
  Description of Artificial Sequence: Synthetic peptide
TKPYFH

SEQ ID NO: 52 - protein, 6 aa, Artificial Sequence
  Description of Artificial Sequence: Synthetic peptide
TKPYYH

SEQ ID NO: 53 - protein, 6 aa, Artificial Sequence
  Description of Artificial Sequence: Synthetic peptide
TKPYHH

SEQ ID NO: 54 - protein, 6 aa, Artificial Sequence
  Description of Artificial Sequence: Synthetic peptide
TKPYPH

SEQ ID NO: 55 - protein, 6 aa, Artificial Sequence
  Description of Artificial Sequence: Synthetic peptide
TKPYKH

SEQ ID NO: 56 - protein, 5 aa, Artificial Sequence
  Description of Artificial Sequence: Synthetic peptide
TKPRH

SEQ ID NO: 57 - protein, 6 aa, Artificial Sequence
  Description of Artificial Sequence: Synthetic peptide
TKPRRH

SEQ ID NO: 58 - protein, 6 aa, Artificial Sequence
  Description of Artificial Sequence: Synthetic peptide
TKPRFH

SEQ ID NO: 59 - protein, 6 aa, Artificial Sequence
  Description of Artificial Sequence: Synthetic peptide
TKPRYH

SEQ ID NO: 60 - protein, 6 aa, Artificial Sequence
  Description of Artificial Sequence: Synthetic peptide
TKPRHH

SEQ ID NO: 61 - protein, 6 aa, Artificial Sequence
  Description of Artificial Sequence: Synthetic peptide
TKPRPH

SEQ ID NO: 62 - protein, 6 aa, Artificial Sequence
  Description of Artificial Sequence: Synthetic peptide
TKPRKH

SEQ ID NO: 63 - protein, 5 aa, Artificial Sequence
  Description of Artificial Sequence: Synthetic peptide
MTKPH

SEQ ID NO: 64 - protein, 6 aa, Artificial Sequence
  Description of Artificial Sequence: Synthetic peptide
MTKPRH

SEQ ID NO: 65 - protein, 6 aa, Artificial Sequence
  Description of Artificial Sequence: Synthetic peptide
MTKPFH

SEQ ID NO: 66 - protein, 6 aa, Artificial Sequence
  Description of Artificial Sequence: Synthetic peptide
MTKPYH

SEQ ID NO: 67 - protein, 6 aa, Artificial Sequence
  Description of Artificial Sequence: Synthetic peptide
MTKPGH

SEQ ID NO: 68 - protein, 6 aa, Artificial Sequence
  Description of Artificial Sequence: Synthetic peptide
MTKPHH

SEQ ID NO: 69 - protein, 6 aa, Artificial Sequence
  Description of Artificial Sequence: Synthetic peptide
MTKPKH

SEQ ID NO: 70 - protein, 6 aa, Artificial Sequence
  Description of Artificial Sequence: Synthetic peptide
MTKPGH

SEQ ID NO: 71 - protein, 7 aa, Artificial Sequence
  Description of Artificial Sequence: Synthetic peptide
MTKPGRH

SEQ ID NO: 72 - protein, 7 aa, Artificial Sequence
  Description of Artificial Sequence: Synthetic peptide
MTKPGFH

SEQ ID NO: 73 - protein, 7 aa, Artificial Sequence
  Description of Artificial Sequence: Synthetic peptide
MTKPGYH

SEQ ID NO: 74 - protein, 7 aa, Artificial Sequence
  Description of Artificial Sequence: Synthetic peptide
MTKPGHH

SEQ ID NO: 75 - protein, 7 aa, Artificial Sequence
  Description of Artificial Sequence: Synthetic peptide
MTKPGPH

SEQ ID NO: 76 - protein, 7 aa, Artificial Sequence
  Description of Artificial Sequence: Synthetic peptide
MTKPGKH

SEQ ID NO: 77 - protein, 6 aa, Artificial Sequence
  Description of Artificial Sequence: Synthetic peptide
MTKPDH

SEQ ID NO: 78 - protein, 7 aa, Artificial Sequence
  Description of Artificial Sequence: Synthetic peptide
MTKPDRH

SEQ ID NO: 79 - protein, 7 aa, Artificial Sequence
  Description of Artificial Sequence: Synthetic peptide
MTKPDFH

SEQ ID NO: 80 - protein, 7 aa, Artificial Sequence
  Description of Artificial Sequence: Synthetic peptide
MTKPDYH

SEQ ID NO: 81 - protein, 7 aa, Artificial Sequence
  Description of Artificial Sequence: Synthetic peptide
MTKPDHH

SEQ ID NO: 82 - protein, 7 aa, Artificial Sequence
  Description of Artificial Sequence: Synthetic peptide
MTKPDPH

SEQ ID NO: 83 - protein, 7 aa, Artificial Sequence
  Description of Artificial Sequence: Synthetic peptide
MTKPDKH

SEQ ID NO: 84 - protein, 6 aa, Artificial Sequence
  Description of Artificial Sequence: Synthetic peptide
MTKPWH

SEQ ID NO: 85 - protein, 7 aa, Artificial Sequence
  Description of Artificial Sequence: Synthetic peptide
MTKPWRH

SEQ ID NO: 86 - protein, 7 aa, Artificial Sequence
  Description of Artificial Sequence: Synthetic peptide
MTKPWFH

SEQ ID NO: 87 - protein, 7 aa, Artificial Sequence
  Description of Artificial Sequence: Synthetic peptide
MTKPWYH

SEQ ID NO: 88 - protein, 7 aa, Artificial Sequence
  Description of Artificial Sequence: Synthetic peptide
MTKPWHH

SEQ ID NO: 89 - protein, 7 aa, Artificial Sequence
  Description of Artificial Sequence: Synthetic peptide
MTKPWPH

SEQ ID NO: 90 - protein, 7 aa, Artificial Sequence
  Description of Artificial Sequence: Synthetic peptide
MTKPWKH

SEQ ID NO: 91 - protein, 6 aa, Artificial Sequence
  Description of Artificial Sequence: Synthetic peptide
MTKPQH

SEQ ID NO: 92 - protein, 7 aa, Artificial Sequence
  Description of Artificial Sequence: Synthetic peptide
MTKPQRH

SEQ ID NO: 93 - protein, 7 aa, Artificial Sequence
  Description of Artificial Sequence: Synthetic peptide
MTKPQFH

SEQ ID NO: 94 - protein, 7 aa, Artificial Sequence
  Description of Artificial Sequence: Synthetic peptide
MTKPQYH

SEQ ID NO: 95 - protein, 7 aa, Artificial Sequence
  Description of Artificial Sequence: Synthetic peptide
MTKPQHH

SEQ ID NO: 96 - protein, 7 aa, Artificial Sequence
  Description of Artificial Sequence: Synthetic peptide
MTKPQPH

SEQ ID NO: 97 - protein, 7 aa, Artificial Sequence
  Description of Artificial Sequence: Synthetic peptide
MTKPQKH

SEQ ID NO: 98 - protein, 6 aa, Artificial Sequence
  Description of Artificial Sequence: Synthetic peptide
MTKPNH

SEQ ID NO: 99 - protein, 7 aa, Artificial Sequence
  Description of Artificial Sequence: Synthetic peptide
MTKPNRH

SEQ ID NO: 100 - protein, 7 aa, Artificial Sequence
  Description of Artificial Sequence: Synthetic peptide
MTKPNFH

SEQ ID NO: 101 - protein, 7 aa, Artificial Sequence
  Description of Artificial Sequence: Synthetic peptide
MTKPNYH

SEQ ID NO: 102 - protein, 7 aa, Artificial Sequence
  Description of Artificial Sequence: Synthetic peptide
MTKPNHH

SEQ ID NO: 103 - protein, 7 aa, Artificial Sequence
  Description of Artificial Sequence: Synthetic peptide
MTKPNPH

SEQ ID NO: 104 - protein, 7 aa, Artificial Sequence
  Description of Artificial Sequence: Synthetic peptide
MTKPNKH

SEQ ID NO: 105 - protein, 6 aa, Artificial Sequence
  Description of Artificial Sequence: Synthetic peptide
MTKPYH

SEQ ID NO: 106 - protein, 7 aa, Artificial Sequence
  Description of Artificial Sequence: Synthetic peptide
MTKPYRH

SEQ ID NO: 107 - protein, 7 aa, Artificial Sequence
  Description of Artificial Sequence: Synthetic peptide
MTKPYFH

SEQ ID NO: 108 - protein, 7 aa, Artificial Sequence
  Description of Artificial Sequence: Synthetic peptide
MTKPYYH

SEQ ID NO: 109 - protein, 7 aa, Artificial Sequence
  Description of Artificial Sequence: Synthetic peptide
MTKPYHH

SEQ ID NO: 110 - protein, 7 aa, Artificial Sequence
  Description of Artificial Sequence: Synthetic peptide
MTKPYPH

SEQ ID NO: 111 - protein, 7 aa, Artificial Sequence
  Description of Artificial Sequence: Synthetic peptide
MTKPYKH

SEQ ID NO: 112 - protein, 6 aa, Artificial Sequence
  Description of Artificial Sequence: Synthetic peptide
MTKPRH

SEQ ID NO: 113 - protein, 7 aa, Artificial Sequence
  Description of Artificial Sequence: Synthetic peptide
MTKPRRH

SEQ ID NO: 114 - protein, 7 aa, Artificial Sequence
  Description of Artificial Sequence: Synthetic peptide
MTKPRFH

SEQ ID NO: 115 - protein, 7 aa, Artificial Sequence
  Description of Artificial Sequence: Synthetic peptide
MTKPRYH

SEQ ID NO: 116 - protein, 7 aa, Artificial Sequence
  Description of Artificial Sequence: Synthetic peptide
MTKPRHH

SEQ ID NO: 117 - protein, 7 aa, Artificial Sequence
  Description of Artificial Sequence: Synthetic peptide
MTKPRPH

SEQ ID NO: 118 - protein, 7 aa, Artificial Sequence
  Description of Artificial Sequence: Synthetic peptide
MTKPRKH

SEQ ID NO: 119 - protein, 5 aa, Artificial Sequence
  Description of Artificial Sequence: Synthetic peptide
MTKPH

SEQ ID NO: 120 - protein, 6 aa, Artificial Sequence
  Description of Artificial Sequence: Synthetic peptide
MTKPRH

SEQ ID NO: 121 - protein, 6 aa, Artificial Sequence
  Description of Artificial Sequence: Synthetic peptide
MTKPFH

SEQ ID NO: 122 - protein, 6 aa, Artificial Sequence
  Description of Artificial Sequence: Synthetic peptide
MTKPYH

SEQ ID NO: 123 - protein, 6 aa, Artificial Sequence
  Description of Artificial Sequence: Synthetic peptide
MTKPGH

SEQ ID NO: 124 - protein, 6 aa, Artificial Sequence
  Description of Artificial Sequence: Synthetic peptide
MTKPHH

SEQ ID NO: 125 - protein, 6 aa, Artificial Sequence
  Description of Artificial Sequence: Synthetic peptide
MTKPKH

SEQ ID NO: 126 - protein, 6 aa, Artificial Sequence
  Description of Artificial Sequence: Synthetic peptide
MTKPGH

SEQ ID NO: 127 - protein, 7 aa, Artificial Sequence
  Description of Artificial Sequence: Synthetic peptide
MTKPGRH

SEQ ID NO: 128 - protein, 7 aa, Artificial Sequence
  Description of Artificial Sequence: Synthetic peptide
MTKPGFH

SEQ ID NO: 129 - protein, 7 aa, Artificial Sequence
  Description of Artificial Sequence: Synthetic peptide
MTKPGYH

SEQ ID NO: 130 - protein, 7 aa, Artificial Sequence
  Description of Artificial Sequence: Synthetic peptide
MTKPGHH

SEQ ID NO: 131 - protein, 7 aa, Artificial Sequence
  Description of Artificial Sequence: Synthetic peptide
MTKPGPH

SEQ ID NO: 132 - protein, 7 aa, Artificial Sequence
  Description of Artificial Sequence: Synthetic peptide
MTKPGKH

SEQ ID NO: 133 - protein, 6 aa, Artificial Sequence
  Description of Artificial Sequence: Synthetic peptide
MTKPDH

SEQ ID NO: 134 - protein, 7 aa, Artificial Sequence
  Description of Artificial Sequence: Synthetic peptide
MTKPDRH

SEQ ID NO: 135 - protein, 7 aa, Artificial Sequence
  Description of Artificial Sequence: Synthetic peptide
MTKPDFH

SEQ ID NO: 136 - protein, 7 aa, Artificial Sequence
  Description of Artificial Sequence: Synthetic peptide
MTKPDYH

SEQ ID NO: 137 - protein, 7 aa, Artificial Sequence
  Description of Artificial Sequence: Synthetic peptide
MTKPDHH

SEQ ID NO: 138 - protein, 7 aa, Artificial Sequence
  Description of Artificial Sequence: Synthetic peptide
MTKPDPH

SEQ ID NO: 139 - protein, 7 aa, Artificial Sequence
  Description of Artificial Sequence: Synthetic peptide
MTKPDKH

SEQ ID NO: 140 - protein, 6 aa, Artificial Sequence
  Description of Artificial Sequence: Synthetic peptide
MTKPWH

SEQ ID NO: 141 - protein, 7 aa, Artificial Sequence
  Description of Artificial Sequence: Synthetic peptide
MTKPWRH

SEQ ID NO: 142 - protein, 7 aa, Artificial Sequence
  Description of Artificial Sequence: Synthetic peptide
MTKPWFH

SEQ ID NO: 143 - protein, 7 aa, Artificial Sequence
  Description of Artificial Sequence: Synthetic peptide
MTKPWYH

SEQ ID NO: 144 - protein, 7 aa, Artificial Sequence
  Description of Artificial Sequence: Synthetic peptide
MTKPWHH

SEQ ID NO: 145 - protein, 7 aa, Artificial Sequence
  Description of Artificial Sequence: Synthetic peptide
MTKPWPH

SEQ ID NO: 146 - protein, 7 aa, Artificial Sequence
  Description of Artificial Sequence: Synthetic peptide
MTKPWKH

SEQ ID NO: 147 - protein, 6 aa, Artificial Sequence
  Description of Artificial Sequence: Synthetic peptide
MTKPQH

SEQ ID NO: 148 - protein, 7 aa, Artificial Sequence
  Description of Artificial Sequence: Synthetic peptide
MTKPQRH

SEQ ID NO: 149 - protein, 7 aa, Artificial Sequence
  Description of Artificial Sequence: Synthetic peptide
MTKPQFH

SEQ ID NO: 150 - protein, 7 aa, Artificial Sequence
  Description of Artificial Sequence: Synthetic peptide
MTKPQYH

SEQ ID NO: 151 - protein, 7 aa, Artificial Sequence
  Description of Artificial Sequence: Synthetic peptide
MTKPQHH

SEQ ID NO: 152 - protein, 7 aa, Artificial Sequence
  Description of Artificial Sequence: Synthetic peptide
MTKPQPH

SEQ ID NO: 153 - protein, 7 aa, Artificial Sequence
  Description of Artificial Sequence: Synthetic peptide
MTKPQKH

SEQ ID NO: 154 - protein, 6 aa, Artificial Sequence
  Description of Artificial Sequence: Synthetic peptide
MTKPNH

SEQ ID NO: 155 - protein, 7 aa, Artificial Sequence
  Description of Artificial Sequence: Synthetic peptide
MTKPNRH

SEQ ID NO: 156 - protein, 7 aa, Artificial Sequence
  Description of Artificial Sequence: Synthetic peptide
MTKPNFH

SEQ ID NO: 157 - protein, 7 aa, Artificial Sequence
  Description of Artificial Sequence: Synthetic peptide
MTKPNYH

SEQ ID NO: 158 - protein, 7 aa, Artificial Sequence
  Description of Artificial Sequence: Synthetic peptide
MTKPNHH

SEQ ID NO: 159 - protein, 7 aa, Artificial Sequence
  Description of Artificial Sequence: Synthetic peptide
MTKPNPH

SEQ ID NO: 160 - protein, 7 aa, Artificial Sequence
  Description of Artificial Sequence: Synthetic peptide
MTKPNKH

SEQ ID NO: 161 - protein, 6 aa, Artificial Sequence
  Description of Artificial Sequence: Synthetic peptide
MTKPYH

SEQ ID NO: 162 - protein, 7 aa, Artificial Sequence
  Description of Artificial Sequence: Synthetic peptide
MTKPYRH

SEQ ID NO: 163 - protein, 7 aa, Artificial Sequence
  Description of Artificial Sequence: Synthetic peptide
MTKPYFH

SEQ ID NO: 164 - protein, 7 aa, Artificial Sequence
  Description of Artificial Sequence: Synthetic peptide
MTKPYYH

SEQ ID NO: 165 - protein, 7 aa, Artificial Sequence
  Description of Artificial Sequence: Synthetic peptide
MTKPYHH

SEQ ID NO: 166 - protein, 7 aa, Artificial Sequence
  Description of Artificial Sequence: Synthetic peptide
MTKPYPH

SEQ ID NO: 167 - protein, 7 aa, Artificial Sequence
  Description of Artificial Sequence: Synthetic peptide
MTKPYKH

SEQ ID NO: 168 - protein, 6 aa, Artificial Sequence
  Description of Artificial Sequence: Synthetic peptide
MTKPRH

SEQ ID NO: 169 - protein, 7 aa, Artificial Sequence
  Description of Artificial Sequence: Synthetic peptide
MTKPRRH

SEQ ID NO: 170 - protein, 7 aa, Artificial Sequence
  Description of Artificial Sequence: Synthetic peptide
MTKPRFH

SEQ ID NO: 171 - protein, 7 aa, Artificial Sequence
  Description of Artificial Sequence: Synthetic peptide
MTKPRYH

SEQ ID NO: 172 - protein, 7 aa, Artificial Sequence
  Description of Artificial Sequence: Synthetic peptide
MTKPRHH

SEQ ID NO: 173 - protein, 7 aa, Artificial Sequence
  Description of Artificial Sequence: Synthetic peptide
MTKPRPH

SEQ ID NO: 174 - protein, 7 aa, Artificial Sequence
  Description of Artificial Sequence: Synthetic peptide
MTKPRKH

SEQ ID NO: 175 - protein, 5 aa, Artificial Sequence
  Description of Artificial Sequence: Synthetic peptide
TTKPH

SEQ ID NO: 176 - protein, 6 aa, Artificial Sequence
  Description of Artificial Sequence: Synthetic peptide
TTKPRH

SEQ ID NO: 177 - protein, 6 aa, Artificial Sequence
  Description of Artificial Sequence: Synthetic peptide
TTKPFH

SEQ ID NO: 178 - protein, 6 aa, Artificial Sequence
  Description of Artificial Sequence: Synthetic peptide
TTKPYH

SEQ ID NO: 179 - protein, 6 aa, Artificial Sequence
  Description of Artificial Sequence: Synthetic peptide
TTKPGH

SEQ ID NO: 180 - protein, 6 aa, Artificial Sequence
  Description of Artificial Sequence: Synthetic peptide
TTKPHH

SEQ ID NO: 181 - protein, 6 aa, Artificial Sequence
  Description of Artificial Sequence: Synthetic peptide
TTKPKH

SEQ ID NO: 182 - protein, 6 aa, Artificial Sequence
  Description of Artificial Sequence: Synthetic peptide
TTKPGH

SEQ ID NO: 183 - protein, 7 aa, Artificial Sequence
  Description of Artificial Sequence: Synthetic peptide
TTKPGRH

SEQ ID NO: 184 - protein, 7 aa, Artificial Sequence
  Description of Artificial Sequence: Synthetic peptide
TTKPGFH

SEQ ID NO: 185 - protein, 7 aa, Artificial Sequence
  Description of Artificial Sequence: Synthetic peptide
TTKPGYH

SEQ ID NO: 186 - protein, 7 aa, Artificial Sequence
  Description of Artificial Sequence: Synthetic peptide
TTKPGHH

SEQ ID NO: 187 - protein, 7 aa, Artificial Sequence
  Description of Artificial Sequence: Synthetic peptide
TTKPGPH

SEQ ID NO: 188 - protein, 7 aa, Artificial Sequence
  Description of Artificial Sequence: Synthetic peptide
TTKPGKH

SEQ ID NO: 189 - protein, 6 aa, Artificial Sequence
  Description of Artificial Sequence: Synthetic peptide
TTKPDH

SEQ ID NO: 190 - protein, 7 aa, Artificial Sequence
  Description of Artificial Sequence: Synthetic peptide
TTKPDRH

SEQ ID NO: 191 - protein, 7 aa, Artificial Sequence
  Description of Artificial Sequence: Synthetic peptide
TTKPDFH

SEQ ID NO: 192 - protein, 7 aa, Artificial Sequence
  Description of Artificial Sequence: Synthetic peptide
TTKPDYH

SEQ ID NO: 193 - protein, 7 aa, Artificial Sequence
  Description of Artificial Sequence: Synthetic peptide
TTKPDHH

SEQ ID NO: 194 - protein, 7 aa, Artificial Sequence
  Description of Artificial Sequence: Synthetic peptide
TTKPDPH

SEQ ID NO: 195 - protein, 7 aa, Artificial Sequence
  Description of Artificial Sequence: Synthetic peptide
TTKPDKH

SEQ ID NO: 196 - protein, 6 aa, Artificial Sequence
  Description of Artificial Sequence: Synthetic peptide
TTKPWH

SEQ ID NO: 197 - protein, 7 aa, Artificial Sequence
  Description of Artificial Sequence: Synthetic peptide
TTKPWRH

SEQ ID NO: 198 - protein, 7 aa, Artificial Sequence
  Description of Artificial Sequence: Synthetic peptide
TTKPWFH

SEQ ID NO: 199 - protein, 7 aa, Artificial Sequence
  Description of Artificial Sequence: Synthetic peptide
TTKPWYH

SEQ ID NO: 200 - protein, 7 aa, Artificial Sequence
  Description of Artificial Sequence: Synthetic peptide
TTKPWHH

SEQ ID NO: 201 - protein, 7 aa, Artificial Sequence
  Description of Artificial Sequence: Synthetic peptide
TTKPWPH

SEQ ID NO: 202 - protein, 7 aa, Artificial Sequence
  Description of Artificial Sequence: Synthetic peptide
TTKPWKH

SEQ ID NO: 203 - protein, 6 aa, Artificial Sequence
  Description of Artificial Sequence: Synthetic peptide
TTKPQH

SEQ ID NO: 204 - protein, 7 aa, Artificial Sequence
  Description of Artificial Sequence: Synthetic peptide
TTKPQRH

SEQ ID NO: 205 - protein, 7 aa, Artificial Sequence
  Description of Artificial Sequence: Synthetic peptide
TTKPQFH

SEQ ID NO: 206 - protein, 7 aa, Artificial Sequence
  Description of Artificial Sequence: Synthetic peptide
TTKPQYH

SEQ ID NO: 207 - protein, 7 aa, Artificial Sequence
  Description of Artificial Sequence: Synthetic peptide
TTKPQHH

SEQ ID NO: 208 - protein, 7 aa, Artificial Sequence
  Description of Artificial Sequence: Synthetic peptide
TTKPQPH

SEQ ID NO: 209 - protein, 7 aa, Artificial Sequence
  Description of Artificial Sequence: Synthetic peptide
TTKPQKH

SEQ ID NO: 210 - protein, 6 aa, Artificial Sequence
  Description of Artificial Sequence: Synthetic peptide
TTKPNH

SEQ ID NO: 211 - protein, 7 aa, Artificial Sequence
  Description of Artificial Sequence: Synthetic peptide
TTKPNRH

SEQ ID NO: 212 - protein, 7 aa, Artificial Sequence
  Description of Artificial Sequence: Synthetic peptide
TTKPNFH

SEQ ID NO: 213 - protein, 7 aa, Artificial Sequence
  Description of Artificial Sequence: Synthetic peptide
TTKPNYH

SEQ ID NO: 214 - protein, 7 aa, Artificial Sequence
  Description of Artificial Sequence: Synthetic peptide
TTKPNHH

SEQ ID NO: 215 - protein, 7 aa, Artificial Sequence
  Description of Artificial Sequence: Synthetic peptide
TTKPNPH

SEQ ID NO: 216 - protein, 7 aa, Artificial Sequence
  Description of Artificial Sequence: Synthetic peptide
TTKPNKH

SEQ ID NO: 217 - protein, 6 aa, Artificial Sequence
  Description of Artificial Sequence: Synthetic peptide
TTKPYH

SEQ ID NO: 218 - protein, 7 aa, Artificial Sequence
  Description of Artificial Sequence: Synthetic peptide
TTKPYRH

SEQ ID NO: 219 - protein, 7 aa, Artificial Sequence
  Description of Artificial Sequence: Synthetic peptide
TTKPYFH

SEQ ID NO: 220 - protein, 7 aa, Artificial Sequence
  Description of Artificial Sequence: Synthetic peptide
TTKPYYH

SEQ ID NO: 221 - protein, 7 aa, Artificial Sequence
  Description of Artificial Sequence: Synthetic peptide
TTKPYHH

SEQ ID NO: 222 - protein, 7 aa, Artificial Sequence
  Description of Artificial Sequence: Synthetic peptide
TTKPYPH

SEQ ID NO: 223 - protein, 7 aa, Artificial Sequence
  Description of Artificial Sequence: Synthetic peptide
TTKPYKH

SEQ ID NO: 224 - protein, 6 aa, Artificial Sequence
  Description of Artificial Sequence: Synthetic peptide
TTKPRH

SEQ ID NO: 225 - protein, 7 aa, Artificial Sequence
  Description of Artificial Sequence: Synthetic peptide
TTKPRRH

SEQ ID NO: 226 - protein, 7 aa, Artificial Sequence
  Description of Artificial Sequence: Synthetic peptide
TTKPRFH

SEQ ID NO: 227 - protein, 7 aa, Artificial Sequence
  Description of Artificial Sequence: Synthetic peptide
TTKPRYH

SEQ ID NO: 228 - protein, 7 aa, Artificial Sequence
  Description of Artificial Sequence: Synthetic peptide
TTKPRHH

SEQ ID NO: 229 - protein, 7 aa, Artificial Sequence
  Description of Artificial Sequence: Synthetic peptide
TTKPRPH

SEQ ID NO: 230 - protein, 7 aa, Artificial Sequence
  Description of Artificial Sequence: Synthetic peptide
TTKPRKH

SEQ ID NO: 231 - protein, 5 aa, Artificial Sequence
  Description of Artificial Sequence: Synthetic peptide
ATKPH

SEQ ID NO: 232 - protein, 6 aa, Artificial Sequence
  Description of Artificial Sequence: Synthetic peptide
ATKPRH

SEQ ID NO: 233 - protein, 6 aa, Artificial Sequence
  Description of Artificial Sequence: Synthetic peptide
ATKPFH

SEQ ID NO: 234 - protein, 6 aa, Artificial Sequence
  Description of Artificial Sequence: Synthetic peptide
ATKPYH

SEQ ID NO: 235 - protein, 6 aa, Artificial Sequence
  Description of Artificial Sequence: Synthetic peptide
ATKPGH

SEQ ID NO: 236 - protein, 6 aa, Artificial Sequence
  Description of Artificial Sequence: Synthetic peptide
ATKPHH

SEQ ID NO: 237 - protein, 6 aa, Artificial Sequence
  Description of Artificial Sequence: Synthetic peptide
ATKPKH

SEQ ID NO: 238 - protein, 6 aa, Artificial Sequence
  Description of Artificial Sequence: Synthetic peptide
ATKPGH

SEQ ID NO: 239 - protein, 7 aa, Artificial Sequence
  Description of Artificial Sequence: Synthetic peptide
ATKPGRH

SEQ ID NO: 240 - protein, 7 aa, Artificial Sequence
  Description of Artificial Sequence: Synthetic peptide
ATKPGFH

SEQ ID NO: 241 - protein, 7 aa, Artificial Sequence
  Description of Artificial Sequence: Synthetic peptide
ATKPGYH

SEQ ID NO: 242 - protein, 7 aa, Artificial Sequence
  Description of Artificial Sequence: Synthetic peptide
ATKPGHH

SEQ ID NO: 243 - protein, 7 aa, Artificial Sequence
  Description of Artificial Sequence: Synthetic peptide
ATKPGPH

SEQ ID NO: 244 - protein, 7 aa, Artificial Sequence
  Description of Artificial Sequence: Synthetic peptide
ATKPGKH

SEQ ID NO: 245 - protein, 6 aa, Artificial Sequence
  Description of Artificial Sequence: Synthetic peptide
ATKPDH

SEQ ID NO: 246 - protein, 7 aa, Artificial Sequence
  Description of Artificial Sequence: Synthetic peptide
ATKPDRH

SEQ ID NO: 247 - protein, 7 aa, Artificial Sequence
  Description of Artificial Sequence: Synthetic peptide
ATKPDFH

SEQ ID NO: 248 - protein, 7 aa, Artificial Sequence
  Description of Artificial Sequence: Synthetic peptide
ATKPDYH

SEQ ID NO: 249 - protein, 7 aa, Artificial Sequence
  Description of Artificial Sequence: Synthetic peptide
ATKPDHH

SEQ ID NO: 250 - protein, 7 aa, Artificial Sequence
  Description of Artificial Sequence: Synthetic peptide
ATKPDPH

SEQ ID NO: 251 - protein, 7 aa, Artificial Sequence
  Description of Artificial Sequence: Synthetic peptide
ATKPDKH

SEQ ID NO: 252 - protein, 6 aa, Artificial Sequence
  Description of Artificial Sequence: Synthetic peptide
ATKPWH

SEQ ID NO: 253 - protein, 7 aa, Artificial Sequence
  Description of Artificial Sequence: Synthetic peptide
ATKPWRH

SEQ ID NO: 254 - protein, 7 aa, Artificial Sequence
  Description of Artificial Sequence: Synthetic peptide
ATKPWFH

SEQ ID NO: 255 - protein, 7 aa, Artificial Sequence
  Description of Artificial Sequence: Synthetic peptide
ATKPWYH

SEQ ID NO: 256 - protein, 7 aa, Artificial Sequence
  Description of Artificial Sequence: Synthetic peptide
ATKPWHH

SEQ ID NO: 257 - protein, 7 aa, Artificial Sequence
  Description of Artificial Sequence: Synthetic peptide
ATKPWPH

SEQ ID NO: 258 - protein, 7 aa, Artificial Sequence
  Description of Artificial Sequence: Synthetic peptide
ATKPWKH

SEQ ID NO: 259 - protein, 6 aa, Artificial Sequence
  Description of Artificial Sequence: Synthetic peptide
ATKPQH

SEQ ID NO: 260 - protein, 7 aa, Artificial Sequence
  Description of Artificial Sequence: Synthetic peptide
ATKPQRH

SEQ ID NO: 261 - protein, 7 aa, Artificial Sequence
  Description of Artificial Sequence: Synthetic peptide
ATKPQFH

SEQ ID NO: 262 - protein, 7 aa, Artificial Sequence
  Description of Artificial Sequence: Synthetic peptide
ATKPQYH

SEQ ID NO: 263 - protein, 7 aa, Artificial Sequence
  Description of Artificial Sequence: Synthetic peptide
ATKPQHH

SEQ ID NO: 264 - protein, 7 aa, Artificial Sequence
  Description of Artificial Sequence: Synthetic peptide
ATKPQPH

SEQ ID NO: 265 - protein, 7 aa, Artificial Sequence
  Description of Artificial Sequence: Synthetic peptide
ATKPQKH

SEQ ID NO: 266 - protein, 6 aa, Artificial Sequence
  Description of Artificial Sequence: Synthetic peptide
ATKPNH

SEQ ID NO: 267 - protein, 7 aa, Artificial Sequence
  Description of Artificial Sequence: Synthetic peptide
ATKPNRH

SEQ ID NO: 268 - protein, 7 aa, Artificial Sequence
  Description of Artificial Sequence: Synthetic peptide
ATKPNFH

SEQ ID NO: 269 - protein, 7 aa, Artificial Sequence
  Description of Artificial Sequence: Synthetic peptide
ATKPNYH

SEQ ID NO: 270 - protein, 7 aa, Artificial Sequence
  Description of Artificial Sequence: Synthetic peptide
ATKPNHH

SEQ ID NO: 271 - protein, 7 aa, Artificial Sequence
  Description of Artificial Sequence: Synthetic peptide
ATKPNPH

SEQ ID NO: 272 - protein, 7 aa, Artificial Sequence
  Description of Artificial Sequence: Synthetic peptide
ATKPNKH

SEQ ID NO: 273 - protein, 6 aa, Artificial Sequence
  Description of Artificial Sequence: Synthetic peptide
ATKPYH

SEQ ID NO: 274 - protein, 7 aa, Artificial Sequence
  Description of Artificial Sequence: Synthetic peptide
ATKPYRH

SEQ ID NO: 275 - protein, 7 aa, Artificial Sequence
  Description of Artificial Sequence: Synthetic peptide
ATKPYFH

SEQ ID NO: 276 - protein, 7 aa, Artificial Sequence
  Description of Artificial Sequence: Synthetic peptide
ATKPYYH

SEQ ID NO: 277 - protein, 7 aa, Artificial Sequence
  Description of Artificial Sequence: Synthetic peptide
ATKPYHH

SEQ ID NO: 278 - protein, 7 aa, Artificial Sequence
  Description of Artificial Sequence: Synthetic peptide
ATKPYPH

SEQ ID NO: 279 - protein, 7 aa, Artificial Sequence
  Description of Artificial Sequence: Synthetic peptide
ATKPYKH

SEQ ID NO: 280 - protein, 6 aa, Artificial Sequence
  Description of Artificial Sequence: Synthetic peptide
ATKPRH

SEQ ID NO: 281 - protein, 7 aa, Artificial Sequence
  Description of Artificial Sequence: Synthetic peptide
ATKPRRH

SEQ ID NO: 282 - protein, 7 aa, Artificial Sequence
  Description of Artificial Sequence: Synthetic peptide
ATKPRFH

SEQ ID NO: 283 - protein, 7 aa, Artificial Sequence
  Description of Artificial Sequence: Synthetic peptide
ATKPRYH

SEQ ID NO: 284 - protein, 7 aa, Artificial Sequence
  Description of Artificial Sequence: Synthetic peptide
ATKPRHH

SEQ ID NO: 285 - protein, 7 aa, Artificial Sequence
  Description of Artificial Sequence: Synthetic peptide
ATKPRPH

SEQ ID NO: 286 - protein, 7 aa, Artificial Sequence
  Description of Artificial Sequence: Synthetic peptide
ATKPRKH

SEQ ID NO: 287 - protein, 5 aa, Artificial Sequence
  Description of Artificial Sequence: Synthetic peptide
HTKPH

SEQ ID NO: 288 - protein, 6 aa, Artificial Sequence
  Description of Artificial Sequence: Synthetic peptide
HTKPRH

SEQ ID NO: 289 - protein, 6 aa, Artificial Sequence
  Description of Artificial Sequence: Synthetic peptide
HTKPFH

SEQ ID NO: 290 - protein, 6 aa, Artificial Sequence
  Description of Artificial Sequence: Synthetic peptide
HTKPYH

SEQ ID NO: 291 - protein, 6 aa, Artificial Sequence
  Description of Artificial Sequence: Synthetic peptide
HTKPGH

SEQ ID NO: 292 - protein, 6 aa, Artificial Sequence
  Description of Artificial Sequence: Synthetic peptide
HTKPHH

SEQ ID NO: 293 - protein, 6 aa, Artificial Sequence
  Description of Artificial Sequence: Synthetic peptide
HTKPKH

SEQ ID NO: 294 - protein, 6 aa, Artificial Sequence
  Description of Artificial Sequence: Synthetic peptide
HTKPGH

SEQ ID NO: 295 - protein, 7 aa, Artificial Sequence
  Description of Artificial Sequence: Synthetic peptide
HTKPGRH

SEQ ID NO: 296 - protein, 7 aa, Artificial Sequence
  Description of Artificial Sequence: Synthetic peptide
HTKPGFH

SEQ ID NO: 297 - protein, 7 aa, Artificial Sequence
  Description of Artificial Sequence: Synthetic peptide
HTKPGYH

SEQ ID NO: 298 - protein, 7 aa, Artificial Sequence
  Description of Artificial Sequence: Synthetic peptide
HTKPGHH

SEQ ID NO: 299 - protein, 7 aa, Artificial Sequence
  Description of Artificial Sequence: Synthetic peptide
HTKPGPH

SEQ ID NO: 300 - protein, 7 aa, Artificial Sequence
  Description of Artificial Sequence: Synthetic peptide
HTKPGKH

SEQ ID NO: 301 - protein, 6 aa, Artificial Sequence
  Description of Artificial Sequence: Synthetic peptide
HTKPDH

SEQ ID NO: 302 - protein, 7 aa, Artificial Sequence
  Description of Artificial Sequence: Synthetic peptide
HTKPDRH

SEQ ID NO: 303 - protein, 7 aa, Artificial Sequence
  Description of Artificial Sequence: Synthetic peptide
HTKPDFH

SEQ ID NO: 304 - protein, 7 aa, Artificial Sequence
  Description of Artificial Sequence: Synthetic peptide
HTKPDYH

SEQ ID NO: 305 - protein, 7 aa, Artificial Sequence
  Description of Artificial Sequence: Synthetic peptide
HTKPDHH

SEQ ID NO: 306 - protein, 7 aa, Artificial Sequence
  Description of Artificial Sequence: Synthetic peptide
HTKPDPH

SEQ ID NO: 307 - protein, 7 aa, Artificial Sequence
  Description of Artificial Sequence: Synthetic peptide
HTKPDKH

SEQ ID NO: 308 - protein, 6 aa, Artificial Sequence
  Description of Artificial Sequence: Synthetic peptide
HTKPWH

SEQ ID NO: 309 - protein, 7 aa, Artificial Sequence
  Description of Artificial Sequence: Synthetic peptide
HTKPWRH

SEQ ID NO: 310 - protein, 7 aa, Artificial Sequence
  Description of Artificial Sequence: Synthetic peptide
HTKPWFH

SEQ ID NO: 311 - protein, 7 aa, Artificial Sequence
  Description of Artificial Sequence: Synthetic peptide
HTKPWYH

SEQ ID NO: 312 - protein, 7 aa, Artificial Sequence
  Description of Artificial Sequence: Synthetic peptide
HTKPWHH

SEQ ID NO: 313 - protein, 7 aa, Artificial Sequence
  Description of Artificial Sequence: Synthetic peptide
HTKPWPH

SEQ ID NO: 314 - protein, 7 aa, Artificial Sequence
  Description of Artificial Sequence: Synthetic peptide
HTKPWKH

SEQ ID NO: 315 - protein, 6 aa, Artificial Sequence
  Description of Artificial Sequence: Synthetic peptide
HTKPQH

SEQ ID NO: 316 - protein, 7 aa, Artificial Sequence
  Description of Artificial Sequence: Synthetic peptide
HTKPQRH

SEQ ID NO: 317 - protein, 7 aa, Artificial Sequence
  Description of Artificial Sequence: Synthetic peptide
HTKPQFH

SEQ ID NO: 318 - protein, 7 aa, Artificial Sequence
  Description of Artificial Sequence: Synthetic peptide
HTKPQYH

SEQ ID NO: 319 - protein, 7 aa, Artificial Sequence
  Description of Artificial Sequence: Synthetic peptide
HTKPQHH

SEQ ID NO: 320 - protein, 7 aa, Artificial Sequence
  Description of Artificial Sequence: Synthetic peptide
HTKPQPH

SEQ ID NO: 321 - protein, 7 aa, Artificial Sequence
  Description of Artificial Sequence: Synthetic peptide
HTKPQKH

SEQ ID NO: 322 - protein, 6 aa, Artificial Sequence
  Description of Artificial Sequence: Synthetic peptide
HTKPNH

SEQ ID NO: 323 - protein, 7 aa, Artificial Sequence
  Description of Artificial Sequence: Synthetic peptide
HTKPNRH

SEQ ID NO: 324 - protein, 7 aa, Artificial Sequence
  Description of Artificial Sequence: Synthetic peptide
HTKPNFH

SEQ ID NO: 325 - protein, 7 aa, Artificial Sequence
  Description of Artificial Sequence: Synthetic peptide
HTKPNYH

SEQ ID NO: 326 - protein, 7 aa, Artificial Sequence
  Description of Artificial Sequence: Synthetic peptide
HTKPNHH

SEQ ID NO: 327 - protein, 7 aa, Artificial Sequence
  Description of Artificial Sequence: Synthetic peptide
HTKPNPH

SEQ ID NO: 328 - protein, 7 aa, Artificial Sequence
  Description of Artificial Sequence: Synthetic peptide
HTKPNKH

SEQ ID NO: 329 - protein, 6 aa, Artificial Sequence
  Description of Artificial Sequence: Synthetic peptide
HTKPYH

SEQ ID NO: 330 - protein, 7 aa, Artificial Sequence
  Description of Artificial Sequence: Synthetic peptide
HTKPYRH

SEQ ID NO: 331 - protein, 7 aa, Artificial Sequence
  Description of Artificial Sequence: Synthetic peptide
HTKPYFH

SEQ ID NO: 332 - protein, 7 aa, Artificial Sequence
  Description of Artificial Sequence: Synthetic peptide
HTKPYYH

SEQ ID NO: 333 - protein, 7 aa, Artificial Sequence
  Description of Artificial Sequence: Synthetic peptide
HTKPYHH

SEQ ID NO: 334 - protein, 7 aa, Artificial Sequence
  Description of Artificial Sequence: Synthetic peptide
HTKPYPH

SEQ ID NO: 335 - protein, 7 aa, Artificial Sequence
  Description of Artificial Sequence: Synthetic peptide
HTKPYKH

SEQ ID NO: 336 - protein, 6 aa, Artificial Sequence
  Description of Artificial Sequence: Synthetic peptide
HTKPRH

SEQ ID NO: 337 - protein, 7 aa, Artificial Sequence
  Description of Artificial Sequence: Synthetic peptide
HTKPRRH

SEQ ID NO: 338 - protein, 7 aa, Artificial Sequence
  Description of Artificial Sequence: Synthetic peptide
HTKPRFH

SEQ ID NO: 339 - protein, 7 aa, Artificial Sequence
  Description of Artificial Sequence: Synthetic peptide
HTKPRYH

SEQ ID NO: 340 - protein, 7 aa, Artificial Sequence
  Description of Artificial Sequence: Synthetic peptide
HTKPRHH

SEQ ID NO: 341 - protein, 7 aa, Artificial Sequence
  Description of Artificial Sequence: Synthetic peptide
HTKPRPH

SEQ ID NO: 342 - protein, 7 aa, Artificial Sequence
  Description of Artificial Sequence: Synthetic peptide
HTKPRKH

SEQ ID NO: 343 - protein, 5 aa, Artificial Sequence
  Description of Artificial Sequence: Synthetic peptide
KTKPH

SEQ ID NO: 344 - protein, 6 aa, Artificial Sequence
  Description of Artificial Sequence: Synthetic peptide
KTKPRH

SEQ ID NO: 345 - protein, 6 aa, Artificial Sequence
  Description of Artificial Sequence: Synthetic peptide
KTKPFH

SEQ ID NO: 346 - protein, 6 aa, Artificial Sequence
  Description of Artificial Sequence: Synthetic peptide
KTKPYH

SEQ ID NO: 347 - protein, 6 aa, Artificial Sequence
  Description of Artificial Sequence: Synthetic peptide
KTKPGH

SEQ ID NO: 348 - protein, 6 aa, Artificial Sequence
  Description of Artificial Sequence: Synthetic peptide
KTKPHH

SEQ ID NO: 349 - protein, 6 aa, Artificial Sequence
  Description of Artificial Sequence: Synthetic peptide
KTKPKH

SEQ ID NO: 350 - protein, 6 aa, Artificial Sequence
  Description of Artificial Sequence: Synthetic peptide
KTKPGH

SEQ ID NO: 351 - protein, 7 aa, Artificial Sequence
  Description of Artificial Sequence: Synthetic peptide
KTKPGRH

SEQ ID NO: 352 - protein, 7 aa, Artificial Sequence
  Description of Artificial Sequence: Synthetic peptide
KTKPGFH

SEQ ID NO: 353 - protein, 7 aa, Artificial Sequence
  Description of Artificial Sequence: Synthetic peptide
KTKPGYH

SEQ ID NO: 354 - protein, 7 aa, Artificial Sequence
  Description of Artificial Sequence: Synthetic peptide
KTKPGHH

SEQ ID NO: 355 - protein, 7 aa, Artificial Sequence
  Description of Artificial Sequence: Synthetic peptide
KTKPGPH

SEQ ID NO: 356 - protein, 7 aa, Artificial Sequence
  Description of Artificial Sequence: Synthetic peptide
KTKPGKH

SEQ ID NO: 357 - protein, 6 aa, Artificial Sequence
  Description of Artificial Sequence: Synthetic peptide
KTKPDH

SEQ ID NO: 358 - protein, 7 aa, Artificial Sequence
  Description of Artificial Sequence: Synthetic peptide
KTKPDRH

SEQ ID NO: 359 - protein, 7 aa, Artificial Sequence
  Description of Artificial Sequence: Synthetic peptide
KTKPDFH

SEQ ID NO: 360 - protein, 7 aa, Artificial Sequence
  Description of Artificial Sequence: Synthetic peptide
KTKPDYH

SEQ ID NO: 361 - protein, 7 aa, Artificial Sequence
  Description of Artificial Sequence: Synthetic peptide
KTKPDHH

SEQ ID NO: 362 - protein, 7 aa, Artificial Sequence
  Description of Artificial Sequence: Synthetic peptide
KTKPDPH

SEQ ID NO: 363 - protein, 7 aa, Artificial Sequence
  Description of Artificial Sequence: Synthetic peptide
KTKPDKH

SEQ ID NO: 364 - protein, 6 aa, Artificial Sequence
  Description of Artificial Sequence: Synthetic peptide
KTKPWH

SEQ ID NO: 365 - protein, 7 aa, Artificial Sequence
  Description of Artificial Sequence: Synthetic peptide
KTKPWRH

SEQ ID NO: 366 - protein, 7 aa, Artificial Sequence
  Description of Artificial Sequence: Synthetic peptide
KTKPWFH

SEQ ID NO: 367 - protein, 7 aa, Artificial Sequence
  Description of Artificial Sequence: Synthetic peptide
KTKPWYH

SEQ ID NO: 368 - protein, 7 aa, Artificial Sequence
  Description of Artificial Sequence: Synthetic peptide
KTKPWHH

SEQ ID NO: 369 - protein, 7 aa, Artificial Sequence
  Description of Artificial Sequence: Synthetic peptide
KTKPWPH

SEQ ID NO: 370 - protein, 7 aa, Artificial Sequence
  Description of Artificial Sequence: Synthetic peptide
KTKPWKH

SEQ ID NO: 371 - protein, 6 aa, Artificial Sequence
  Description of Artificial Sequence: Synthetic peptide
KTKPQH

SEQ ID NO: 372 - protein, 7 aa, Artificial Sequence
  Description of Artificial Sequence: Synthetic peptide
KTKPQRH

SEQ ID NO: 373 - protein, 7 aa, Artificial Sequence
  Description of Artificial Sequence: Synthetic peptide
KTKPQFH

SEQ ID NO: 374 - protein, 7 aa, Artificial Sequence
  Description of Artificial Sequence: Synthetic peptide
KTKPQYH

SEQ ID NO: 375 - protein, 7 aa, Artificial Sequence
  Description of Artificial Sequence: Synthetic peptide
KTKPQHH

SEQ ID NO: 376 - protein, 7 aa, Artificial Sequence
  Description of Artificial Sequence: Synthetic peptide
KTKPQPH

SEQ ID NO: 377 - protein, 7 aa, Artificial Sequence
  Description of Artificial Sequence: Synthetic peptide
KTKPQKH

SEQ ID NO: 378 - protein, 6 aa, Artificial Sequence
  Description of Artificial Sequence: Synthetic peptide
KTKPNH

SEQ ID NO: 379 - protein, 7 aa, Artificial Sequence
  Description of Artificial Sequence: Synthetic peptide
KTKPNRH

SEQ ID NO: 380 - protein, 7 aa, Artificial Sequence
  Description of Artificial Sequence: Synthetic peptide
KTKPNFH

SEQ ID NO: 381 - protein, 7 aa, Artificial Sequence
  Description of Artificial Sequence: Synthetic peptide
KTKPNYH

SEQ ID NO: 382 - protein, 7 aa, Artificial Sequence
  Description of Artificial Sequence: Synthetic peptide
KTKPNHH

SEQ ID NO: 383 - protein, 7 aa, Artificial Sequence
  Description of Artificial Sequence: Synthetic peptide
KTKPNPH

SEQ ID NO: 384 - protein, 7 aa, Artificial Sequence
  Description of Artificial Sequence: Synthetic peptide
KTKPNKH

SEQ ID NO: 385 - protein, 6 aa, Artificial Sequence
  Description of Artificial Sequence: Synthetic peptide
KTKPYH

SEQ ID NO: 386 - protein, 7 aa, Artificial Sequence
  Description of Artificial Sequence: Synthetic peptide
KTKPYRH

SEQ ID NO: 387 - protein, 7 aa, Artificial Sequence
  Description of Artificial Sequence: Synthetic peptide
KTKPYFH

SEQ ID NO: 388 - protein, 7 aa, Artificial Sequence
  Description of Artificial Sequence: Synthetic peptide
KTKPYYH

SEQ ID NO: 389 - protein, 7 aa, Artificial Sequence
  Description of Artificial Sequence: Synthetic peptide
KTKPYHH

SEQ ID NO: 390 - protein, 7 aa, Artificial Sequence
  Description of Artificial Sequence: Synthetic peptide
KTKPYPH

SEQ ID NO: 391 - protein, 7 aa, Artificial Sequence
  Description of Artificial Sequence: Synthetic peptide
KTKPYKH

SEQ ID NO: 392 - protein, 6 aa, Artificial Sequence
  Description of Artificial Sequence: Synthetic peptide
KTKPRH

SEQ ID NO: 393 - protein, 7 aa, Artificial Sequence
  Description of Artificial Sequence: Synthetic peptide
KTKPRRH

SEQ ID NO: 394 - protein, 7 aa, Artificial Sequence
  Description of Artificial Sequence: Synthetic peptide
KTKPRFH

SEQ ID NO: 395 - protein, 7 aa, Artificial Sequence
  Description of Artificial Sequence: Synthetic peptide
KTKPRYH

SEQ ID NO: 396 - protein, 7 aa, Artificial Sequence
  Description of Artificial Sequence: Synthetic peptide
KTKPRHH

SEQ ID NO: 397 - protein, 7 aa, Artificial Sequence
  Description of Artificial Sequence: Synthetic peptide
KTKPRPH

SEQ ID NO: 398 - protein, 7 aa, Artificial Sequence
  Description of Artificial Sequence: Synthetic peptide
KTKPRKH

SEQ ID NO: 399 - protein, 5 aa, Artificial Sequence
  Description of Artificial Sequence: Synthetic peptide
GTKPH

SEQ ID NO: 400 - protein, 6 aa, Artificial Sequence
  Description of Artificial Sequence: Synthetic peptide
GTKPRH

SEQ ID NO: 401 - protein, 6 aa, Artificial Sequence
  Description of Artificial Sequence: Synthetic peptide
GTKPFH

SEQ ID NO: 402 - protein, 6 aa, Artificial Sequence
  Description of Artificial Sequence: Synthetic peptide
GTKPYH

SEQ ID NO: 403 - protein, 6 aa, Artificial Sequence
  Description of Artificial Sequence: Synthetic peptide
GTKPGH

SEQ ID NO: 404 - protein, 6 aa, Artificial Sequence
  Description of Artificial Sequence: Synthetic peptide
GTKPHH

SEQ ID NO: 405 - protein, 6 aa, Artificial Sequence
  Description of Artificial Sequence: Synthetic peptide
GTKPKH

SEQ ID NO: 406 - protein, 6 aa, Artificial Sequence
  Description of Artificial Sequence: Synthetic peptide
GTKPGH

SEQ ID NO: 407 - protein, 7 aa, Artificial Sequence
  Description of Artificial Sequence: Synthetic peptide
GTKPGRH

SEQ ID NO: 408 - protein, 7 aa, Artificial Sequence
  Description of Artificial Sequence: Synthetic peptide
GTKPGFH

SEQ ID NO: 409 - protein, 7 aa, Artificial Sequence
  Description of Artificial Sequence: Synthetic peptide
GTKPGYH

SEQ ID NO: 410 - protein, 7 aa, Artificial Sequence
  Description of Artificial Sequence: Synthetic peptide
GTKPGHH

SEQ ID NO: 411 - protein, 7 aa, Artificial Sequence
  Description of Artificial Sequence: Synthetic peptide
GTKPGPH

SEQ ID NO: 412 - protein, 7 aa, Artificial Sequence
  Description of Artificial Sequence: Synthetic peptide
GTKPGKH

SEQ ID NO: 413 - protein, 6 aa, Artificial Sequence
  Description of Artificial Sequence: Synthetic peptide
GTKPDH

SEQ ID NO: 414 - protein, 7 aa, Artificial Sequence
  Description of Artificial Sequence: Synthetic peptide
GTKPDRH

SEQ ID NO: 415 - protein, 7 aa, Artificial Sequence
  Description of Artificial Sequence: Synthetic peptide
GTKPDFH

SEQ ID NO: 416 - protein, 7 aa, Artificial Sequence
  Description of Artificial Sequence: Synthetic peptide
GTKPDYH

SEQ ID NO: 417 - protein, 7 aa, Artificial Sequence
  Description of Artificial Sequence: Synthetic peptide
GTKPDHH

SEQ ID NO: 418 - protein, 7 aa, Artificial Sequence
  Description of Artificial Sequence: Synthetic peptide
GTKPDPH

SEQ ID NO: 419 - protein, 7 aa, Artificial Sequence
  Description of Artificial Sequence: Synthetic peptide
GTKPDKH

SEQ ID NO: 420 - protein, 6 aa, Artificial Sequence
  Description of Artificial Sequence: Synthetic peptide
GTKPWH

SEQ ID NO: 421 - protein, 7 aa, Artificial Sequence
  Description of Artificial Sequence: Synthetic peptide
GTKPWRH

SEQ ID NO: 422 - protein, 7 aa, Artificial Sequence
  Description of Artificial Sequence: Synthetic peptide
GTKPWFH

SEQ ID NO: 423 - protein, 7 aa, Artificial Sequence
  Description of Artificial Sequence: Synthetic peptide
GTKPWYH

SEQ ID NO: 424 - protein, 7 aa, Artificial Sequence
  Description of Artificial Sequence: Synthetic peptide
GTKPWHH

SEQ ID NO: 425 - protein, 7 aa, Artificial Sequence
  Description of Artificial Sequence: Synthetic peptide
GTKPWPH

SEQ ID NO: 426 - protein, 7 aa, Artificial Sequence
  Description of Artificial Sequence: Synthetic peptide
GTKPWKH

SEQ ID NO: 427 - protein, 6 aa, Artificial Sequence
  Description of Artificial Sequence: Synthetic peptide
GTKPQH

SEQ ID NO: 428 - protein, 7 aa, Artificial Sequence
  Description of Artificial Sequence: Synthetic peptide
GTKPQRH

SEQ ID NO: 429 - protein, 7 aa, Artificial Sequence
  Description of Artificial Sequence: Synthetic peptide
GTKPQFH

SEQ ID NO: 430 - protein, 7 aa, Artificial Sequence
  Description of Artificial Sequence: Synthetic peptide
GTKPQYH

SEQ ID NO: 431 - protein, 7 aa, Artificial Sequence
  Description of Artificial Sequence: Synthetic peptide
GTKPQHH

SEQ ID NO: 432 - protein, 7 aa, Artificial Sequence
  Description of Artificial Sequence: Synthetic peptide
GTKPQPH

SEQ ID NO: 433 - protein, 7 aa, Artificial Sequence
  Description of Artificial Sequence: Synthetic peptide
GTKPQKH

SEQ ID NO: 434 - protein, 6 aa, Artificial Sequence
  Description of Artificial Sequence: Synthetic peptide
GTKPNH

SEQ ID NO: 435 - protein, 7 aa, Artificial Sequence
  Description of Artificial Sequence: Synthetic peptide
GTKPNRH

SEQ ID NO: 436 - protein, 7 aa, Artificial Sequence
  Description of Artificial Sequence: Synthetic peptide
GTKPNFH

SEQ ID NO: 437 - protein, 7 aa, Artificial Sequence
  Description of Artificial Sequence: Synthetic peptide
GTKPNYH

SEQ ID NO: 438 - protein, 7 aa, Artificial Sequence
  Description of Artificial Sequence: Synthetic peptide
GTKPNHH

SEQ ID NO: 439 - protein, 7 aa, Artificial Sequence
  Description of Artificial Sequence: Synthetic peptide
GTKPNPH

SEQ ID NO: 440 - protein, 7 aa, Artificial Sequence
  Description of Artificial Sequence: Synthetic peptide
GTKPNKH

SEQ ID NO: 441 - protein, 6 aa, Artificial Sequence
  Description of Artificial Sequence: Synthetic peptide
GTKPYH

SEQ ID NO: 442 - protein, 7 aa, Artificial Sequence
  Description of Artificial Sequence: Synthetic peptide
GTKPYRH

SEQ ID NO: 443 - protein, 7 aa, Artificial Sequence
  Description of Artificial Sequence: Synthetic peptide
GTKPYFH

SEQ ID NO: 444 - protein, 7 aa, Artificial Sequence
  Description of Artificial Sequence: Synthetic peptide
GTKPYYH

SEQ ID NO: 445 - protein, 7 aa, Artificial Sequence
  Description of Artificial Sequence: Synthetic peptide
GTKPYHH

SEQ ID NO: 446 - protein, 7 aa, Artificial Sequence
  Description of Artificial Sequence: Synthetic peptide
GTKPYPH

SEQ ID NO: 447 - protein, 7 aa, Artificial Sequence
  Description of Artificial Sequence: Synthetic peptide
GTKPYKH

SEQ ID NO: 448 - protein, 6 aa, Artificial Sequence
  Description of Artificial Sequence: Synthetic peptide
GTKPRH

SEQ ID NO: 449 - protein, 7 aa, Artificial Sequence
  Description of Artificial Sequence: Synthetic peptide
GTKPRRH

SEQ ID NO: 450 - protein, 7 aa, Artificial Sequence
  Description of Artificial Sequence: Synthetic peptide
GTKPRFH

SEQ ID NO: 451 - protein, 7 aa, Artificial Sequence
  Description of Artificial Sequence: Synthetic peptide
GTKPRYH

SEQ ID NO: 452 - protein, 7 aa, Artificial Sequence
  Description of Artificial Sequence: Synthetic peptide
GTKPRHH

SEQ ID NO: 453 - protein, 7 aa, Artificial Sequence
  Description of Artificial Sequence: Synthetic peptide
GTKPRPH

SEQ ID NO: 454 - protein, 7 aa, Artificial Sequence
  Description of Artificial Sequence: Synthetic peptide
GTKPRKH

SEQ ID NO: 455 - protein, 3 aa, Artificial Sequence
  Description of Artificial Sequence: Synthetic peptide
TKP

SEQ ID NO: 456 - protein, 5 aa, Artificial Sequence
  Description of Artificial Sequence: Synthetic peptide
TKPGR

SEQ ID NO: 457 - protein, 5 aa, Artificial Sequence
  Description of Artificial Sequence: Synthetic peptide
TKPGF

SEQ ID NO: 458 - protein, 5 aa, Artificial Sequence
  Description of Artificial Sequence: Synthetic peptide
TKPGY

SEQ ID NO: 459 - protein, 5 aa, Artificial Sequence
  Description of Artificial Sequence: Synthetic peptide
TKPGH

SEQ ID NO: 460 - protein, 5 aa, Artificial Sequence
  Description of Artificial Sequence: Synthetic peptide
TKPGP

SEQ ID NO: 461 - protein, 5 aa, Artificial Sequence
  Description of Artificial Sequence: Synthetic peptide
TKPGK

SEQ ID NO: 462 - protein, 5 aa, Artificial Sequence
  Description of Artificial Sequence: Synthetic peptide
TKPDR

SEQ ID NO: 463 - protein, 5 aa, Artificial Sequence
  Description of Artificial Sequence: Synthetic peptide
TKPDF

SEQ ID NO: 464 - protein, 5 aa, Artificial Sequence
  Description of Artificial Sequence: Synthetic peptide
TKPDY

SEQ ID NO: 465 - protein, 5 aa, Artificial Sequence
  Description of Artificial Sequence: Synthetic peptide
TKPDH

SEQ ID NO: 466 - protein, 5 aa, Artificial Sequence
  Description of Artificial Sequence: Synthetic peptide
TKPDP

SEQ ID NO: 467 - protein, 5 aa, Artificial Sequence
  Description of Artificial Sequence: Synthetic peptide
TKPDK

SEQ ID NO: 468 - protein, 5 aa, Artificial Sequence
  Description of Artificial Sequence: Synthetic peptide
TKPWR

SEQ ID NO: 469 - protein, 5 aa, Artificial Sequence
  Description of Artificial Sequence: Synthetic peptide
TKPWF

SEQ ID NO: 470 - protein, 5 aa, Artificial Sequence
  Description of Artificial Sequence: Synthetic peptide
TKPWY

SEQ ID NO: 471 - protein, 5 aa, Artificial Sequence
  Description of Artificial Sequence: Synthetic peptide
TKPWH

SEQ ID NO: 472 - protein, 5 aa, Artificial Sequence
  Description of Artificial Sequence: Synthetic peptide
TKPWP

SEQ ID NO: 473 - protein, 5 aa, Artificial Sequence
  Description of Artificial Sequence: Synthetic peptide
TKPWK

SEQ ID NO: 474 - protein, 5 aa, Artificial Sequence
  Description of Artificial Sequence: Synthetic peptide
TKPQR

SEQ ID NO: 475 - protein, 5 aa, Artificial Sequence
  Description of Artificial Sequence: Synthetic peptide
TKPQF

SEQ ID NO: 476 - protein, 5 aa, Artificial Sequence
  Description of Artificial Sequence: Synthetic peptide
TKPQY

SEQ ID NO: 477 - protein, 5 aa, Artificial Sequence
  Description of Artificial Sequence: Synthetic peptide
TKPQH

SEQ ID NO: 478 - protein, 5 aa, Artificial Sequence
  Description of Artificial Sequence: Synthetic peptide
TKPQP

SEQ ID NO: 479 - protein, 5 aa, Artificial Sequence
  Description of Artificial Sequence: Synthetic peptide
TKPQK

SEQ ID NO: 480 - protein, 5 aa, Artificial Sequence
  Description of Artificial Sequence: Synthetic peptide
TKPNR

SEQ ID NO: 481 - protein, 5 aa, Artificial Sequence
  Description of Artificial Sequence: Synthetic peptide
TKPNF

SEQ ID NO: 482 - protein, 5 aa, Artificial Sequence
  Description of Artificial Sequence: Synthetic peptide
TKPNY

SEQ ID NO: 483 - protein, 5 aa, Artificial Sequence
  Description of Artificial Sequence: Synthetic peptide
TKPNH

SEQ ID NO: 484 - protein, 5 aa, Artificial Sequence
  Description of Artificial Sequence: Synthetic peptide
TKPNP

SEQ ID NO: 485 - protein, 5 aa, Artificial Sequence
  Description of Artificial Sequence: Synthetic peptide
TKPNK

SEQ ID NO: 486 - protein, 5 aa, Artificial Sequence
  Description of Artificial Sequence: Synthetic peptide
TKPYR

SEQ ID NO: 487 - protein, 5 aa, Artificial Sequence
  Description of Artificial Sequence: Synthetic peptide
TKPYF

SEQ ID NO: 488 - protein, 5 aa, Artificial Sequence
  Description of Artificial Sequence: Synthetic peptide
TKPYY

SEQ ID NO: 489 - protein, 5 aa, Artificial Sequence
  Description of Artificial Sequence: Synthetic peptide
TKPYH

SEQ ID NO: 490 - protein, 5 aa, Artificial Sequence
  Description of Artificial Sequence: Synthetic peptide
TKPYP

SEQ ID NO: 491 - protein, 5 aa, Artificial Sequence
  Description of Artificial Sequence: Synthetic peptide
TKPYK

SEQ ID NO: 492 - protein, 5 aa, Artificial Sequence
  Description of Artificial Sequence: Synthetic peptide
TKPRR

SEQ ID NO: 493 - protein, 5 aa, Artificial Sequence
  Description of Artificial Sequence: Synthetic peptide
TKPRF

SEQ ID NO: 494 - protein, 5 aa, Artificial Sequence
  Description of Artificial Sequence: Synthetic peptide
TKPRY

SEQ ID NO: 495 - protein, 5 aa, Artificial Sequence
  Description of Artificial Sequence: Synthetic peptide
TKPRH

SEQ ID NO: 496 - protein, 5 aa, Artificial Sequence
  Description of Artificial Sequence: Synthetic peptide
TKPRK

SEQ ID NO: 497 - protein, 5 aa, Artificial Sequence
  Description of Artificial Sequence: Synthetic peptide
MTKPR

SEQ ID NO: 498 - protein, 5 aa, Artificial Sequence
  Description of Artificial Sequence: Synthetic peptide
MTKPF

SEQ ID NO: 499 - protein, 5 aa, Artificial Sequence
  Description of Artificial Sequence: Synthetic peptide
MTKPY

SEQ ID NO: 500 - protein, 5 aa, Artificial Sequence
  Description of Artificial Sequence: Synthetic peptide
MTKPG

SEQ ID NO: 501 - protein, 5 aa, Artificial Sequence
  Description of Artificial Sequence: Synthetic peptide
MTKPH

SEQ ID NO: 502 - protein, 5 aa, Artificial Sequence
  Description of Artificial Sequence: Synthetic peptide
MTKPK

SEQ ID NO: 503 - protein, 5 aa, Artificial Sequence
  Description of Artificial Sequence: Synthetic peptide
MTKPG

SEQ ID NO: 504 - protein, 6 aa, Artificial Sequence
  Description of Artificial Sequence: Synthetic peptide
MTKPGR

SEQ ID NO: 505 - protein, 6 aa, Artificial Sequence
  Description of Artificial Sequence: Synthetic peptide
MTKPGF

SEQ ID NO: 506 - protein, 6 aa, Artificial Sequence
  Description of Artificial Sequence: Synthetic peptide
MTKPGY

SEQ ID NO: 507 - protein, 6 aa, Artificial Sequence
  Description of Artificial Sequence: Synthetic peptide
MTKPGH

SEQ ID NO: 508 - protein, 6 aa, Artificial Sequence
  Description of Artificial Sequence: Synthetic peptide
MTKPGP

SEQ ID NO: 509 - protein, 6 aa, Artificial Sequence
  Description of Artificial Sequence: Synthetic peptide
MTKPGK

SEQ ID NO: 510 - protein, 5 aa, Artificial Sequence
  Description of Artificial Sequence: Synthetic peptide
MTKPD

SEQ ID NO: 511 - protein, 6 aa, Artificial Sequence
  Description of Artificial Sequence: Synthetic peptide
MTKPDR

SEQ ID NO: 512 - protein, 6 aa, Artificial Sequence
  Description of Artificial Sequence: Synthetic peptide
MTKPDF

SEQ ID NO: 513 - protein, 6 aa, Artificial Sequence
  Description of Artificial Sequence: Synthetic peptide
MTKPDY

SEQ ID NO: 514 - protein, 6 aa, Artificial Sequence
  Description of Artificial Sequence: Synthetic peptide
MTKPDH

SEQ ID NO: 515 - protein, 6 aa, Artificial Sequence
  Description of Artificial Sequence: Synthetic peptide
MTKPDP

SEQ ID NO: 516 - protein, 6 aa, Artificial Sequence
  Description of Artificial Sequence: Synthetic peptide
MTKPDK

SEQ ID NO: 517 - protein, 5 aa, Artificial Sequence
  Description of Artificial Sequence: Synthetic peptide
MTKPW

SEQ ID NO: 518 - protein, 6 aa, Artificial Sequence
  Description of Artificial Sequence: Synthetic peptide
MTKPWR

SEQ ID NO: 519 - protein, 6 aa, Artificial Sequence
  Description of Artificial Sequence: Synthetic peptide
MTKPWF

SEQ ID NO: 520 - protein, 6 aa, Artificial Sequence
  Description of Artificial Sequence: Synthetic peptide
MTKPWY

SEQ ID NO: 521 - protein, 6 aa, Artificial Sequence
  Description of Artificial Sequence: Synthetic peptide
MTKPWH

SEQ ID NO: 522 - protein, 6 aa, Artificial Sequence
  Description of Artificial Sequence: Synthetic peptide
MTKPWP

SEQ ID NO: 523 - protein, 6 aa, Artificial Sequence
  Description of Artificial Sequence: Synthetic peptide
MTKPWK

SEQ ID NO: 524 - protein, 5 aa, Artificial Sequence
  Description of Artificial Sequence: Synthetic peptide
MTKPQ

SEQ ID NO: 525 - protein, 6 aa, Artificial Sequence
  Description of Artificial Sequence: Synthetic peptide
MTKPQR

SEQ ID NO: 526 - protein, 6 aa, Artificial Sequence
  Description of Artificial Sequence: Synthetic peptide
MTKPQF

SEQ ID NO: 527 - protein, 6 aa, Artificial Sequence
  Description of Artificial Sequence: Synthetic peptide
MTKPQY

SEQ ID NO: 528 - protein, 6 aa, Artificial Sequence
  Description of Artificial Sequence: Synthetic peptide
MTKPQH

SEQ ID NO: 529 - protein, 6 aa, Artificial Sequence
  Description of Artificial Sequence: Synthetic peptide
MTKPQP

SEQ ID NO: 530 - protein, 6 aa, Artificial Sequence
  Description of Artificial Sequence: Synthetic peptide
MTKPQK

SEQ ID NO: 531 - protein, 5 aa, Artificial Sequence
  Description of Artificial Sequence: Synthetic peptide
MTKPN

SEQ ID NO: 532 - protein, 6 aa, Artificial Sequence
  Description of Artificial Sequence: Synthetic peptide
MTKPNR

SEQ ID NO: 533 - protein, 6 aa, Artificial Sequence
  Description of Artificial Sequence: Synthetic peptide
MTKPNF

SEQ ID NO: 534 - protein, 6 aa, Artificial Sequence
  Description of Artificial Sequence: Synthetic peptide
MTKPNY

SEQ ID NO: 535 - protein, 6 aa, Artificial Sequence
  Description of Artificial Sequence: Synthetic peptide
MTKPNH

SEQ ID NO: 536 - protein, 6 aa, Artificial Sequence
  Description of Artificial Sequence: Synthetic peptide
MTKPNP

SEQ ID NO: 537 - protein, 6 aa, Artificial Sequence
  Description of Artificial Sequence: Synthetic peptide
MTKPNK

SEQ ID NO: 538 - protein, 5 aa, Artificial Sequence
  Description of Artificial Sequence: Synthetic peptide
MTKPY

SEQ ID NO: 539 - protein, 6 aa, Artificial Sequence
  Description of Artificial Sequence: Synthetic peptide
MTKPYR

SEQ ID NO: 540 - protein, 6 aa, Artificial Sequence
  Description of Artificial Sequence: Synthetic peptide
MTKPYF

SEQ ID NO: 541 - protein, 6 aa, Artificial Sequence
  Description of Artificial Sequence: Synthetic peptide
MTKPYY

SEQ ID NO: 542 - protein, 6 aa, Artificial Sequence
  Description of Artificial Sequence: Synthetic peptide
MTKPYH

SEQ ID NO: 543 - protein, 6 aa, Artificial Sequence
  Description of Artificial Sequence: Synthetic peptide
MTKPYP

SEQ ID NO: 544 - protein, 6 aa, Artificial Sequence
  Description of Artificial Sequence: Synthetic peptide
MTKPYK

SEQ ID NO: 545 - protein, 5 aa, Artificial Sequence
  Description of Artificial Sequence: Synthetic peptide
MTKPR

SEQ ID NO: 546 - protein, 6 aa, Artificial Sequence
  Description of Artificial Sequence: Synthetic peptide
MTKPRR

SEQ ID NO: 547 - protein, 6 aa, Artificial Sequence
  Description of Artificial Sequence: Synthetic peptide
MTKPRF

SEQ ID NO: 548 - protein, 6 aa, Artificial Sequence
  Description of Artificial Sequence: Synthetic peptide
MTKPRY

SEQ ID NO: 549 - protein, 6 aa, Artificial Sequence
  Description of Artificial Sequence: Synthetic peptide
MTKPRH

SEQ ID NO: 550 - protein, 6 aa, Artificial Sequence
  Description of Artificial Sequence: Synthetic peptide
MTKPRP

SEQ ID NO: 551 - protein, 6 aa, Artificial Sequence
  Description of Artificial Sequence: Synthetic peptide
MTKPRK

SEQ ID NO: 552 - protein, 5 aa, Artificial Sequence
  Description of Artificial Sequence: Synthetic peptide
MTKPR

SEQ ID NO: 553 - protein, 5 aa, Artificial Sequence
  Description of Artificial Sequence: Synthetic peptide
MTKPF

SEQ ID NO: 554 - protein, 5 aa, Artificial Sequence
  Description of Artificial Sequence: Synthetic peptide
MTKPY

SEQ ID NO: 555 - protein, 5 aa, Artificial Sequence
  Description of Artificial Sequence: Synthetic peptide
MTKPG

SEQ ID NO: 556 - protein, 5 aa, Artificial Sequence
  Description of Artificial Sequence: Synthetic peptide
MTKPH

SEQ ID NO: 557 - protein, 5 aa, Artificial Sequence
  Description of Artificial Sequence: Synthetic peptide
MTKPK

SEQ ID NO: 558 - protein, 5 aa, Artificial Sequence
  Description of Artificial Sequence: Synthetic peptide
MTKPG

SEQ ID NO: 559 - protein, 6 aa, Artificial Sequence
  Description of Artificial Sequence: Synthetic peptide
MTKPGR

SEQ ID NO: 560 - protein, 6 aa, Artificial Sequence
  Description of Artificial Sequence: Synthetic peptide
MTKPGF

SEQ ID NO: 561 - protein, 6 aa, Artificial Sequence
  Description of Artificial Sequence: Synthetic peptide
MTKPGY

SEQ ID NO: 562 - protein, 6 aa, Artificial Sequence
  Description of Artificial Sequence: Synthetic peptide
MTKPGH

SEQ ID NO: 563 - protein, 6 aa, Artificial Sequence
  Description of Artificial Sequence: Synthetic peptide
MTKPGP

SEQ ID NO: 564 - protein, 6 aa, Artificial Sequence
  Description of Artificial Sequence: Synthetic peptide
MTKPGK

SEQ ID NO: 565 - protein, 5 aa, Artificial Sequence
  Description of Artificial Sequence: Synthetic peptide
MTKPD

SEQ ID NO: 566 - protein, 6 aa, Artificial Sequence
  Description of Artificial Sequence: Synthetic peptide
MTKPDR

SEQ ID NO: 567 - protein, 6 aa, Artificial Sequence
  Description of Artificial Sequence: Synthetic peptide
MTKPDF

SEQ ID NO: 568 - protein, 6 aa, Artificial Sequence
  Description of Artificial Sequence: Synthetic peptide
MTKPDY

SEQ ID NO: 569 - protein, 6 aa, Artificial Sequence
  Description of Artificial Sequence: Synthetic peptide
MTKPDH

SEQ ID NO: 570 - protein, 6 aa, Artificial Sequence
  Description of Artificial Sequence: Synthetic peptide
MTKPDP

SEQ ID NO: 571 - protein, 6 aa, Artificial Sequence
  Description of Artificial Sequence: Synthetic peptide
MTKPDK

SEQ ID NO: 572 - protein, 5 aa, Artificial Sequence
  Description of Artificial Sequence: Synthetic peptide
MTKPW

SEQ ID NO: 573 - protein, 6 aa, Artificial Sequence
  Description of Artificial Sequence: Synthetic peptide
MTKPWR

SEQ ID NO: 574 - protein, 6 aa, Artificial Sequence
  Description of Artificial Sequence: Synthetic peptide
MTKPWF

SEQ ID NO: 575 - protein, 6 aa, Artificial Sequence
  Description of Artificial Sequence: Synthetic peptide
MTKPWY

SEQ ID NO: 576 - protein, 6 aa, Artificial Sequence
  Description of Artificial Sequence: Synthetic peptide
MTKPWH

SEQ ID NO: 577 - protein, 6 aa, Artificial Sequence
  Description of Artificial Sequence: Synthetic peptide
MTKPWP

SEQ ID NO: 578 - protein, 6 aa, Artificial Sequence
  Description of Artificial Sequence: Synthetic peptide
MTKPWK

SEQ ID NO: 579 - protein, 5 aa, Artificial Sequence
  Description of Artificial Sequence: Synthetic peptide
MTKPQ

SEQ ID NO: 580 - protein, 6 aa, Artificial Sequence
  Description of Artificial Sequence: Synthetic peptide
MTKPQR

SEQ ID NO: 581 - protein, 6 aa, Artificial Sequence
  Description of Artificial Sequence: Synthetic peptide
MTKPQF

SEQ ID NO: 582 - protein, 6 aa, Artificial Sequence
  Description of Artificial Sequence: Synthetic peptide
MTKPQY

SEQ ID NO: 583 - protein, 6 aa, Artificial Sequence
  Description of Artificial Sequence: Synthetic peptide
MTKPQH

SEQ ID NO: 584 - protein, 6 aa, Artificial Sequence
  Description of Artificial Sequence: Synthetic peptide
MTKPQP

SEQ ID NO: 585 - protein, 6 aa, Artificial Sequence
  Description of Artificial Sequence: Synthetic peptide
MTKPQK

SEQ ID NO: 586 - protein, 5 aa, Artificial Sequence
  Description of Artificial Sequence: Synthetic peptide
MTKPN

SEQ ID NO: 587 - protein, 6 aa, Artificial Sequence
  Description of Artificial Sequence: Synthetic peptide
MTKPNR

SEQ ID NO: 588 - protein, 6 aa, Artificial Sequence
  Description of Artificial Sequence: Synthetic peptide
MTKPNF

SEQ ID NO: 589 - protein, 6 aa, Artificial Sequence
  Description of Artificial Sequence: Synthetic peptide
MTKPNY

SEQ ID NO: 590 - protein, 6 aa, Artificial Sequence
  Description of Artificial Sequence: Synthetic peptide
MTKPNH

SEQ ID NO: 591 - protein, 6 aa, Artificial Sequence
  Description of Artificial Sequence: Synthetic peptide
MTKPNP

SEQ ID NO: 592 - protein, 6 aa, Artificial Sequence
  Description of Artificial Sequence: Synthetic peptide
MTKPNK

SEQ ID NO: 593 - protein, 5 aa, Artificial Sequence
  Description of Artificial Sequence: Synthetic peptide
MTKPY

SEQ ID NO: 594 - protein, 6 aa, Artificial Sequence
  Description of Artificial Sequence: Synthetic peptide
MTKPYR

SEQ ID NO: 595 - protein, 6 aa, Artificial Sequence
  Description of Artificial Sequence: Synthetic peptide
MTKPYF

SEQ ID NO: 596 - protein, 6 aa, Artificial Sequence
  Description of Artificial Sequence: Synthetic peptide
MTKPYY

SEQ ID NO: 597 - protein, 6 aa, Artificial Sequence
  Description of Artificial Sequence: Synthetic peptide
MTKPYH

SEQ ID NO: 598 - protein, 6 aa, Artificial Sequence
  Description of Artificial Sequence: Synthetic peptide
MTKPYP

SEQ ID NO: 599 - protein, 6 aa, Artificial Sequence
  Description of Artificial Sequence: Synthetic peptide
MTKPYK

SEQ ID NO: 600 - protein, 5 aa, Artificial Sequence
  Description of Artificial Sequence: Synthetic peptide
MTKPR

SEQ ID NO: 601 - protein, 6 aa, Artificial Sequence
  Description of Artificial Sequence: Synthetic peptide
MTKPRR

SEQ ID NO: 602 - protein, 6 aa, Artificial Sequence
  Description of Artificial Sequence: Synthetic peptide
MTKPRF

SEQ ID NO: 603 - protein, 6 aa, Artificial Sequence
  Description of Artificial Sequence: Synthetic peptide
MTKPRY

SEQ ID NO: 604 - protein, 6 aa, Artificial Sequence
  Description of Artificial Sequence: Synthetic peptide
MTKPRH

SEQ ID NO: 605 - protein, 6 aa, Artificial Sequence
  Description of Artificial Sequence: Synthetic peptide
MTKPRP

SEQ ID NO: 606 - protein, 6 aa, Artificial Sequence
  Description of Artificial Sequence: Synthetic peptide
MTKPRK

SEQ ID NO: 607 - protein, 5 aa, Artificial Sequence
  Description of Artificial Sequence: Synthetic peptide
TTKPR

SEQ ID NO: 608 - protein, 5 aa, Artificial Sequence
  Description of Artificial Sequence: Synthetic peptide
TTKPF

SEQ ID NO: 609 - protein, 5 aa, Artificial Sequence
  Description of Artificial Sequence: Synthetic peptide
TTKPY

SEQ ID NO: 610 - protein, 5 aa, Artificial Sequence
  Description of Artificial Sequence: Synthetic peptide
TTKPG

SEQ ID NO: 611 - protein, 5 aa, Artificial Sequence
  Description of Artificial Sequence: Synthetic peptide
TTKPH

SEQ ID NO: 612 - protein, 5 aa, Artificial Sequence
  Description of Artificial Sequence: Synthetic peptide
TTKPK

SEQ ID NO: 613 - protein, 5 aa, Artificial Sequence
  Description of Artificial Sequence: Synthetic peptide
TTKPG

SEQ ID NO: 614 - protein, 6 aa, Artificial Sequence
  Description of Artificial Sequence: Synthetic peptide
TTKPGR

SEQ ID NO: 615 - protein, 6 aa, Artificial Sequence
  Description of Artificial Sequence: Synthetic peptide
TTKPGF

SEQ ID NO: 616 - protein, 6 aa, Artificial Sequence
  Description of Artificial Sequence: Synthetic peptide
TTKPGY

SEQ ID NO: 617 - protein, 6 aa, Artificial Sequence
  Description of Artificial Sequence: Synthetic peptide
TTKPGH

SEQ ID NO: 618 - protein, 6 aa, Artificial Sequence
  Description of Artificial Sequence: Synthetic peptide
TTKPGP

SEQ ID NO: 619 - protein, 6 aa, Artificial Sequence
  Description of Artificial Sequence: Synthetic peptide
TTKPGK

SEQ ID NO: 620 - protein, 5 aa, Artificial Sequence
  Description of Artificial Sequence: Synthetic peptide
TTKPD

SEQ ID NO: 621 - protein, 6 aa, Artificial Sequence
  Description of Artificial Sequence: Synthetic peptide
TTKPDR

SEQ ID NO: 622 - protein, 6 aa, Artificial Sequence
  Description of Artificial Sequence: Synthetic peptide
TTKPDF

SEQ ID NO: 623 - protein, 6 aa, Artificial Sequence
  Description of Artificial Sequence: Synthetic peptide
TTKPDY

SEQ ID NO: 624 - protein, 6 aa, Artificial Sequence
  Description of Artificial Sequence: Synthetic peptide
TTKPDH

SEQ ID NO: 625 - protein, 6 aa, Artificial Sequence
  Description of Artificial Sequence: Synthetic peptide
TTKPDP

SEQ ID NO: 626 - protein, 6 aa, Artificial Sequence
  Description of Artificial Sequence: Synthetic peptide
TTKPDK

SEQ ID NO: 627 - protein, 5 aa, Artificial Sequence
  Description of Artificial Sequence: Synthetic peptide
TTKPW

SEQ ID NO: 628 - protein, 6 aa, Artificial Sequence
  Description of Artificial Sequence: Synthetic peptide
TTKPWR

SEQ ID NO: 629 - protein, 6 aa, Artificial Sequence
  Description of Artificial Sequence: Synthetic peptide
TTKPWF

SEQ ID NO: 630 - protein, 6 aa, Artificial Sequence
  Description of Artificial Sequence: Synthetic peptide
TTKPWY

SEQ ID NO: 631 - protein, 6 aa, Artificial Sequence
  Description of Artificial Sequence: Synthetic peptide
TTKPWH

SEQ ID NO: 632 - protein, 6 aa, Artificial Sequence
  Description of Artificial Sequence: Synthetic peptide
TTKPWP

SEQ ID NO: 633 - protein, 6 aa, Artificial Sequence
  Description of Artificial Sequence: Synthetic peptide
TTKPWK

SEQ ID NO: 634 - protein, 5 aa, Artificial Sequence
  Description of Artificial Sequence: Synthetic peptide
TTKPQ

SEQ ID NO: 635 - protein, 6 aa, Artificial Sequence
  Description of Artificial Sequence: Synthetic peptide
TTKPQR

SEQ ID NO: 636 - protein, 6 aa, Artificial Sequence
  Description of Artificial Sequence: Synthetic peptide
TTKPQF

SEQ ID NO: 637 - protein, 6 aa, Artificial Sequence
  Description of Artificial Sequence: Synthetic peptide
TTKPQY

SEQ ID NO: 638 - protein, 6 aa, Artificial Sequence
  Description of Artificial Sequence: Synthetic peptide
TTKPQH

SEQ ID NO: 639 - protein, 6 aa, Artificial Sequence
  Description of Artificial Sequence: Synthetic peptide
TTKPQP

SEQ ID NO: 640 - protein, 6 aa, Artificial Sequence
  Description of Artificial Sequence: Synthetic peptide
TTKPQK

SEQ ID NO: 641 - protein, 5 aa, Artificial Sequence
  Description of Artificial Sequence: Synthetic peptide
TTKPN

SEQ ID NO: 642 - protein, 6 aa, Artificial Sequence
  Description of Artificial Sequence: Synthetic peptide
TTKPNR

SEQ ID NO: 643 - protein, 6 aa, Artificial Sequence
  Description of Artificial Sequence: Synthetic peptide
TTKPNF

SEQ ID NO: 644 - protein, 6 aa, Artificial Sequence
  Description of Artificial Sequence: Synthetic peptide
TTKPNY

SEQ ID NO: 645 - protein, 6 aa, Artificial Sequence
  Description of Artificial Sequence: Synthetic peptide
TTKPNH

SEQ ID NO: 646 - protein, 6 aa, Artificial Sequence
  Description of Artificial Sequence: Synthetic peptide
TTKPNP

SEQ ID NO: 647 - protein, 6 aa, Artificial Sequence
  Description of Artificial Sequence: Synthetic peptide
TTKPNK

SEQ ID NO: 648 - protein, 5 aa, Artificial Sequence
  Description of Artificial Sequence: Synthetic peptide
TTKPY

SEQ ID NO: 649 - protein, 6 aa, Artificial Sequence
  Description of Artificial Sequence: Synthetic peptide
TTKPYR

SEQ ID NO: 650 - protein, 6 aa, Artificial Sequence
  Description of Artificial Sequence: Synthetic peptide
TTKPYF

SEQ ID NO: 651 - protein, 6 aa, Artificial Sequence
  Description of Artificial Sequence: Synthetic peptide
TTKPYY

SEQ ID NO: 652 - protein, 6 aa, Artificial Sequence
  Description of Artificial Sequence: Synthetic peptide
TTKPYH

SEQ ID NO: 653 - protein, 6 aa, Artificial Sequence
  Description of Artificial Sequence: Synthetic peptide
TTKPYP

SEQ ID NO: 654 - protein, 6 aa, Artificial Sequence
  Description of Artificial Sequence: Synthetic peptide
TTKPYK

SEQ ID NO: 655 - protein, 5 aa, Artificial Sequence
  Description of Artificial Sequence: Synthetic peptide
TTKPR

SEQ ID NO: 656 - protein, 6 aa, Artificial Sequence
  Description of Artificial Sequence: Synthetic peptide
TTKPRR

SEQ ID NO: 657 - protein, 6 aa, Artificial Sequence
  Description of Artificial Sequence: Synthetic peptide
TTKPRF

SEQ ID NO: 658 - protein, 6 aa, Artificial Sequence
  Description of Artificial Sequence: Synthetic peptide
TTKPRY

SEQ ID NO: 659 - protein, 6 aa, Artificial Sequence
  Description of Artificial Sequence: Synthetic peptide
TTKPRH

SEQ ID NO: 660 - protein, 6 aa, Artificial Sequence
  Description of Artificial Sequence: Synthetic peptide
TTKPRP

SEQ ID NO: 661 - protein, 6 aa, Artificial Sequence
  Description of Artificial Sequence: Synthetic peptide
TTKPRK

SEQ ID NO: 662 - protein, 5 aa, Artificial Sequence
  Description of Artificial Sequence: Synthetic peptide
ATKPR

SEQ ID NO: 663 - protein, 5 aa, Artificial Sequence
  Description of Artificial Sequence: Synthetic peptide
ATKPF

SEQ ID NO: 664 - protein, 5 aa, Artificial Sequence
  Description of Artificial Sequence: Synthetic peptide
ATKPY

SEQ ID NO: 665 - protein, 5 aa, Artificial Sequence
  Description of Artificial Sequence: Synthetic peptide
ATKPG

SEQ ID NO: 666 - protein, 5 aa, Artificial Sequence
  Description of Artificial Sequence: Synthetic peptide
ATKPH

SEQ ID NO: 667 - protein, 5 aa, Artificial Sequence
  Description of Artificial Sequence: Synthetic peptide
ATKPK

SEQ ID NO: 668 - protein, 5 aa, Artificial Sequence
  Description of Artificial Sequence: Synthetic peptide
ATKPG

SEQ ID NO: 669 - protein, 6 aa, Artificial Sequence
  Description of Artificial Sequence: Synthetic peptide
ATKPGR

SEQ ID NO: 670 - protein, 6 aa, Artificial Sequence
  Description of Artificial Sequence: Synthetic peptide
ATKPGF

SEQ ID NO: 671 - protein, 6 aa, Artificial Sequence
  Description of Artificial Sequence: Synthetic peptide
ATKPGY

SEQ ID NO: 672 - protein, 6 aa, Artificial Sequence
  Description of Artificial Sequence: Synthetic peptide
ATKPGH

SEQ ID NO: 673 - protein, 6 aa, Artificial Sequence
  Description of Artificial Sequence: Synthetic peptide
ATKPGP

SEQ ID NO: 674 - protein, 6 aa, Artificial Sequence
  Description of Artificial Sequence: Synthetic peptide
ATKPGK

SEQ ID NO: 675 - protein, 5 aa, Artificial Sequence
  Description of Artificial Sequence: Synthetic peptide
ATKPD

SEQ ID NO: 676 - protein, 6 aa, Artificial Sequence
  Description of Artificial Sequence: Synthetic peptide
ATKPDR

SEQ ID NO: 677 - protein, 6 aa, Artificial Sequence
  Description of Artificial Sequence: Synthetic peptide
ATKPDF

SEQ ID NO: 678 - protein, 6 aa, Artificial Sequence
  Description of Artificial Sequence: Synthetic peptide
ATKPDY

SEQ ID NO: 679 - protein, 6 aa, Artificial Sequence
  Description of Artificial Sequence: Synthetic peptide
ATKPDH

SEQ ID NO: 680 - protein, 6 aa, Artificial Sequence
  Description of Artificial Sequence: Synthetic peptide
ATKPDP

SEQ ID NO: 681 - protein, 6 aa, Artificial Sequence
  Description of Artificial Sequence: Synthetic peptide
ATKPDK

SEQ ID NO: 682 - protein, 5 aa, Artificial Sequence
  Description of Artificial Sequence: Synthetic peptide
ATKPW

SEQ ID NO: 683 - protein, 6 aa, Artificial Sequence
  Description of Artificial Sequence: Synthetic peptide
ATKPWR

SEQ ID NO: 684 - protein, 6 aa, Artificial Sequence
  Description of Artificial Sequence: Synthetic peptide
ATKPWF

SEQ ID NO: 685 - protein, 6 aa, Artificial Sequence
  Description of Artificial Sequence: Synthetic peptide
ATKPWY

SEQ ID NO: 686 - protein, 6 aa, Artificial Sequence
  Description of Artificial Sequence: Synthetic peptide
ATKPWH

SEQ ID NO: 687 - protein, 6 aa, Artificial Sequence
  Description of Artificial Sequence: Synthetic peptide
ATKPWP

SEQ ID NO: 688 - protein, 6 aa, Artificial Sequence
  Description of Artificial Sequence: Synthetic peptide
ATKPWK

SEQ ID NO: 689 - protein, 5 aa, Artificial Sequence
  Description of Artificial Sequence: Synthetic peptide
ATKPQ

SEQ ID NO: 690 - protein, 6 aa, Artificial Sequence
  Description of Artificial Sequence: Synthetic peptide
ATKPQR

SEQ ID NO: 691 - protein, 6 aa, Artificial Sequence
  Description of Artificial Sequence: Synthetic peptide
ATKPQF

SEQ ID NO: 692 - protein, 6 aa, Artificial Sequence
  Description of Artificial Sequence: Synthetic peptide
ATKPQY

SEQ ID NO: 693 - protein, 6 aa, Artificial Sequence
  Description of Artificial Sequence: Synthetic peptide
ATKPQH

SEQ ID NO: 694 - protein, 6 aa, Artificial Sequence
  Description of Artificial Sequence: Synthetic peptide
ATKPQP

SEQ ID NO: 695 - protein, 6 aa, Artificial Sequence
  Description of Artificial Sequence: Synthetic peptide
ATKPQK

SEQ ID NO: 696 - protein, 5 aa, Artificial Sequence
  Description of Artificial Sequence: Synthetic peptide
ATKPN

SEQ ID NO: 697 - protein, 6 aa, Artificial Sequence
  Description of Artificial Sequence: Synthetic peptide
ATKPNR

SEQ ID NO: 698 - protein, 6 aa, Artificial Sequence
  Description of Artificial Sequence: Synthetic peptide
ATKPNF

SEQ ID NO: 699 - protein, 6 aa, Artificial Sequence
  Description of Artificial Sequence: Synthetic peptide
ATKPNY

SEQ ID NO: 700 - protein, 6 aa, Artificial Sequence
  Description of Artificial Sequence: Synthetic peptide
ATKPNH

SEQ ID NO: 701 - protein, 6 aa, Artificial Sequence
  Description of Artificial Sequence: Synthetic peptide
ATKPNP

SEQ ID NO: 702 - protein, 6 aa, Artificial Sequence
  Description of Artificial Sequence: Synthetic peptide
ATKPNK

SEQ ID NO: 703 - protein, 5 aa, Artificial Sequence
  Description of Artificial Sequence: Synthetic peptide
ATKPY

SEQ ID NO: 704 - protein, 6 aa, Artificial Sequence
  Description of Artificial Sequence: Synthetic peptide
ATKPYR

SEQ ID NO: 705 - protein, 6 aa, Artificial Sequence
  Description of Artificial Sequence: Synthetic peptide
ATKPYF

SEQ ID NO: 706 - protein, 6 aa, Artificial Sequence
  Description of Artificial Sequence: Synthetic peptide
ATKPYY

SEQ ID NO: 707 - protein, 6 aa, Artificial Sequence
  Description of Artificial Sequence: Synthetic peptide
ATKPYH

SEQ ID NO: 708 - protein, 6 aa, Artificial Sequence
  Description of Artificial Sequence: Synthetic peptide
ATKPYP

SEQ ID NO: 709 - protein, 6 aa, Artificial Sequence
  Description of Artificial Sequence: Synthetic peptide
ATKPYK

SEQ ID NO: 710 - protein, 5 aa, Artificial Sequence
  Description of Artificial Sequence: Synthetic peptide
ATKPR

SEQ ID NO: 711 - protein, 6 aa, Artificial Sequence
  Description of Artificial Sequence: Synthetic peptide
ATKPRR

SEQ ID NO: 712 - protein, 6 aa, Artificial Sequence
  Description of Artificial Sequence: Synthetic peptide
ATKPRF

SEQ ID NO: 713 - protein, 6 aa, Artificial Sequence
  Description of Artificial Sequence: Synthetic peptide
ATKPRY

SEQ ID NO: 714 - protein, 6 aa, Artificial Sequence
  Description of Artificial Sequence: Synthetic peptide
ATKPRH

SEQ ID NO: 715 - protein, 6 aa, Artificial Sequence
  Description of Artificial Sequence: Synthetic peptide
ATKPRP

SEQ ID NO: 716 - protein, 6 aa, Artificial Sequence
  Description of Artificial Sequence: Synthetic peptide
ATKPRK

SEQ ID NO: 717 - protein, 5 aa, Artificial Sequence
  Description of Artificial Sequence: Synthetic peptide
HTKPR

SEQ ID NO: 718 - protein, 5 aa, Artificial Sequence
  Description of Artificial Sequence: Synthetic peptide
HTKPF

SEQ ID NO: 719 - protein, 5 aa, Artificial Sequence
  Description of Artificial Sequence: Synthetic peptide
HTKPY

SEQ ID NO: 720 - protein, 5 aa, Artificial Sequence
  Description of Artificial Sequence: Synthetic peptide
HTKPG

SEQ ID NO: 721 - protein, 5 aa, Artificial Sequence
  Description of Artificial Sequence: Synthetic peptide
HTKPH

SEQ ID NO: 722 - protein, 5 aa, Artificial Sequence
  Description of Artificial Sequence: Synthetic peptide
HTKPK

SEQ ID NO: 723 - protein, 5 aa, Artificial Sequence
  Description of Artificial Sequence: Synthetic peptide
HTKPG

SEQ ID NO: 724 - protein, 6 aa, Artificial Sequence
  Description of Artificial Sequence: Synthetic peptide
HTKPGR

SEQ ID NO: 725 - protein, 6 aa, Artificial Sequence
  Description of Artificial Sequence: Synthetic peptide
HTKPGF

SEQ ID NO: 726 - protein, 6 aa, Artificial Sequence
  Description of Artificial Sequence: Synthetic peptide
HTKPGY

SEQ ID NO: 727 - protein, 6 aa, Artificial Sequence
  Description of Artificial Sequence: Synthetic peptide
HTKPGH

SEQ ID NO: 728 - protein, 6 aa, Artificial Sequence
  Description of Artificial Sequence: Synthetic peptide
HTKPGP

SEQ ID NO: 729 - protein, 6 aa, Artificial Sequence
  Description of Artificial Sequence: Synthetic peptide
HTKPGK

SEQ ID NO: 730 - protein, 5 aa, Artificial Sequence
  Description of Artificial Sequence: Synthetic peptide
HTKPD

SEQ ID NO: 731 - protein, 6 aa, Artificial Sequence
  Description of Artificial Sequence: Synthetic peptide
HTKPDR

SEQ ID NO: 732 - protein, 6 aa, Artificial Sequence
  Description of Artificial Sequence: Synthetic peptide
HTKPDF

SEQ ID NO: 733 - protein, 6 aa, Artificial Sequence
  Description of Artificial Sequence: Synthetic peptide
HTKPDY

SEQ ID NO: 734 - protein, 6 aa, Artificial Sequence
  Description of Artificial Sequence: Synthetic peptide
HTKPDH

SEQ ID NO: 735 - protein, 6 aa, Artificial Sequence
  Description of Artificial Sequence: Synthetic peptide
HTKPDP

SEQ ID NO: 736 - protein, 6 aa, Artificial Sequence
  Description of Artificial Sequence: Synthetic peptide
HTKPDK

SEQ ID NO: 737 - protein, 5 aa, Artificial Sequence
  Description of Artificial Sequence: Synthetic peptide
HTKPW

SEQ ID NO: 738 - protein, 6 aa, Artificial Sequence
  Description of Artificial Sequence: Synthetic peptide
HTKPWR

SEQ ID NO: 739 - protein, 6 aa, Artificial Sequence
  Description of Artificial Sequence: Synthetic peptide
HTKPWF

SEQ ID NO: 740 - protein, 6 aa, Artificial Sequence
  Description of Artificial Sequence: Synthetic peptide
HTKPWY

SEQ ID NO: 741 - protein, 6 aa, Artificial Sequence
  Description of Artificial Sequence: Synthetic peptide
HTKPWH

SEQ ID NO: 742 - protein, 6 aa, Artificial Sequence
  Description of Artificial Sequence: Synthetic peptide
HTKPWP

SEQ ID NO: 743 - protein, 6 aa, Artificial Sequence
  Description of Artificial Sequence: Synthetic peptide
HTKPWK

SEQ ID NO: 744 - protein, 5 aa, Artificial Sequence
  Description of Artificial Sequence: Synthetic peptide
HTKPQ

SEQ ID NO: 745 - protein, 6 aa, Artificial Sequence
  Description of Artificial Sequence: Synthetic peptide
HTKPQR

SEQ ID NO: 746 - protein, 6 aa, Artificial Sequence
  Description of Artificial Sequence: Synthetic peptide
HTKPQF

SEQ ID NO: 747 - protein, 6 aa, Artificial Sequence
  Description of Artificial Sequence: Synthetic peptide
HTKPQY

SEQ ID NO: 748 - protein, 6 aa, Artificial Sequence
  Description of Artificial Sequence: Synthetic peptide
HTKPQH

SEQ ID NO: 749 - protein, 6 aa, Artificial Sequence
  Description of Artificial Sequence: Synthetic peptide
HTKPQP

SEQ ID NO: 750 - protein, 6 aa, Artificial Sequence
  Description of Artificial Sequence: Synthetic peptide
HTKPQK

SEQ ID NO: 751 - protein, 5 aa, Artificial Sequence
  Description of Artificial Sequence: Synthetic peptide
HTKPN

SEQ ID NO: 752 - protein, 6 aa, Artificial Sequence
  Description of Artificial Sequence: Synthetic peptide
HTKPNR

SEQ ID NO: 753 - protein, 6 aa, Artificial Sequence
  Description of Artificial Sequence: Synthetic peptide
HTKPNF

SEQ ID NO: 754 - protein, 6 aa, Artificial Sequence
  Description of Artificial Sequence: Synthetic peptide
HTKPNY

SEQ ID NO: 755 - protein, 6 aa, Artificial Sequence
  Description of Artificial Sequence: Synthetic peptide
HTKPNH

SEQ ID NO: 756 - protein, 6 aa, Artificial Sequence
  Description of Artificial Sequence: Synthetic peptide
HTKPNP

SEQ ID NO: 757 - protein, 6 aa, Artificial Sequence
  Description of Artificial Sequence: Synthetic peptide
HTKPNK

SEQ ID NO: 758 - protein, 5 aa, Artificial Sequence
  Description of Artificial Sequence: Synthetic peptide
HTKPY

SEQ ID NO: 759 - protein, 6 aa, Artificial Sequence
  Description of Artificial Sequence: Synthetic peptide
HTKPYR

SEQ ID NO: 760 - protein, 6 aa, Artificial Sequence
  Description of Artificial Sequence: Synthetic peptide
HTKPYF

SEQ ID NO: 761 - protein, 6 aa, Artificial Sequence
  Description of Artificial Sequence: Synthetic peptide
HTKPYY

SEQ ID NO: 762 - protein, 6 aa, Artificial Sequence
  Description of Artificial Sequence: Synthetic peptide
HTKPYH

SEQ ID NO: 763 - protein, 6 aa, Artificial Sequence
  Description of Artificial Sequence: Synthetic peptide
HTKPYP

SEQ ID NO: 764 - protein, 6 aa, Artificial Sequence
  Description of Artificial Sequence: Synthetic peptide
HTKPYK

SEQ ID NO: 765 - protein, 5 aa, Artificial Sequence
  Description of Artificial Sequence: Synthetic peptide
HTKPR

SEQ ID NO: 766 - protein, 6 aa, Artificial Sequence
  Description of Artificial Sequence: Synthetic peptide
HTKPRR

SEQ ID NO: 767 - protein, 6 aa, Artificial Sequence
  Description of Artificial Sequence: Synthetic peptide
HTKPRF

SEQ ID NO: 768 - protein, 6 aa, Artificial Sequence
  Description of Artificial Sequence: Synthetic peptide
HTKPRY

SEQ ID NO: 769 - protein, 6 aa, Artificial Sequence
  Description of Artificial Sequence: Synthetic peptide
HTKPRH

SEQ ID NO: 770 - protein, 6 aa, Artificial Sequence
  Description of Artificial Sequence: Synthetic peptide
HTKPRP

SEQ ID NO: 771 - protein, 6 aa, Artificial Sequence
  Description of Artificial Sequence: Synthetic peptide
HTKPRK

SEQ ID NO: 772 - protein, 5 aa, Artificial Sequence
  Description of Artificial Sequence: Synthetic peptide
KTKPR

SEQ ID NO: 773 - protein, 5 aa, Artificial Sequence
  Description of Artificial Sequence: Synthetic peptide
KTKPF

SEQ ID NO: 774 - protein, 5 aa, Artificial Sequence
  Description of Artificial Sequence: Synthetic peptide
KTKPY

SEQ ID NO: 775 - protein, 5 aa, Artificial Sequence
  Description of Artificial Sequence: Synthetic peptide
KTKPG

SEQ ID NO: 776 - protein, 5 aa, Artificial Sequence
  Description of Artificial Sequence: Synthetic peptide
KTKPH

SEQ ID NO: 777 - protein, 5 aa, Artificial Sequence
  Description of Artificial Sequence: Synthetic peptide
KTKPK

SEQ ID NO: 778 - protein, 5 aa, Artificial Sequence
  Description of Artificial Sequence: Synthetic peptide
KTKPG

SEQ ID NO: 779 - protein, 6 aa, Artificial Sequence
  Description of Artificial Sequence: Synthetic peptide
KTKPGR

SEQ ID NO: 780 - protein, 6 aa, Artificial Sequence
  Description of Artificial Sequence: Synthetic peptide
KTKPGF

SEQ ID NO: 781 - protein, 6 aa, Artificial Sequence
  Description of Artificial Sequence: Synthetic peptide
KTKPGY

SEQ ID NO: 782 - protein, 6 aa, Artificial Sequence
  Description of Artificial Sequence: Synthetic peptide
KTKPGH

SEQ ID NO: 783 - protein, 6 aa, Artificial Sequence
  Description of Artificial Sequence: Synthetic peptide
KTKPGP

SEQ ID NO: 784 - protein, 6 aa, Artificial Sequence
  Description of Artificial Sequence: Synthetic peptide
KTKPGK

SEQ ID NO: 785 - protein, 5 aa, Artificial Sequence
  Description of Artificial Sequence: Synthetic peptide
KTKPD

SEQ ID NO: 786 - protein, 6 aa, Artificial Sequence
  Description of Artificial Sequence: Synthetic peptide
KTKPDR

SEQ ID NO: 787 - protein, 6 aa, Artificial Sequence
  Description of Artificial Sequence: Synthetic peptide
KTKPDF

SEQ ID NO: 788 - protein, 6 aa, Artificial Sequence
  Description of Artificial Sequence: Synthetic peptide
KTKPDY

SEQ ID NO: 789 - protein, 6 aa, Artificial Sequence
  Description of Artificial Sequence: Synthetic peptide
KTKPDH

SEQ ID NO: 790 - protein, 6 aa, Artificial Sequence
  Description of Artificial Sequence: Synthetic peptide
KTKPDP

SEQ ID NO: 791 - protein, 6 aa, Artificial Sequence
  Description of Artificial Sequence: Synthetic peptide
KTKPDK

SEQ ID NO: 792 - protein, 5 aa, Artificial Sequence
  Description of Artificial Sequence: Synthetic peptide
KTKPW

SEQ ID NO: 793 - protein, 6 aa, Artificial Sequence
  Description of Artificial Sequence: Synthetic peptide
KTKPWR

SEQ ID NO: 794 - protein, 6 aa, Artificial Sequence
  Description of Artificial Sequence: Synthetic peptide
KTKPWF

SEQ ID NO: 795 - protein, 6 aa, Artificial Sequence
  Description of Artificial Sequence: Synthetic peptide
KTKPWY

SEQ ID NO: 796 - protein, 6 aa, Artificial Sequence
  Description of Artificial Sequence: Synthetic peptide
KTKPWH

SEQ ID NO: 797 - protein, 6 aa, Artificial Sequence
  Description of Artificial Sequence: Synthetic peptide
KTKPWP

SEQ ID NO: 798 - protein, 6 aa, Artificial Sequence
  Description of Artificial Sequence: Synthetic peptide
KTKPWK

SEQ ID NO: 799 - protein, 5 aa, Artificial Sequence
  Description of Artificial Sequence: Synthetic peptide
KTKPQ

SEQ ID NO: 800 - protein, 6 aa, Artificial Sequence
  Description of Artificial Sequence: Synthetic peptide
KTKPQR

SEQ ID NO: 801 - protein, 6 aa, Artificial Sequence
  Description of Artificial Sequence: Synthetic peptide
KTKPQF

SEQ ID NO: 802 - protein, 6 aa, Artificial Sequence
  Description of Artificial Sequence: Synthetic peptide
KTKPQY

SEQ ID NO: 803 - protein, 6 aa, Artificial Sequence
  Description of Artificial Sequence: Synthetic peptide
KTKPQH

SEQ ID NO: 804 - protein, 6 aa, Artificial Sequence
  Description of Artificial Sequence: Synthetic peptide
KTKPQP

SEQ ID NO: 805 - protein, 6 aa, Artificial Sequence
  Description of Artificial Sequence: Synthetic peptide
KTKPQK

SEQ ID NO: 806 - protein, 5 aa, Artificial Sequence
  Description of Artificial Sequence: Synthetic peptide
KTKPN

SEQ ID NO: 807 - protein, 6 aa, Artificial Sequence
  Description of Artificial Sequence: Synthetic peptide
KTKPNR

SEQ ID NO: 808 - protein, 6 aa, Artificial Sequence
  Description of Artificial Sequence: Synthetic peptide
KTKPNF

SEQ ID NO: 809 - protein, 6 aa, Artificial Sequence
  Description of Artificial Sequence: Synthetic peptide
KTKPNY

SEQ ID NO: 810 - protein, 6 aa, Artificial Sequence
  Description of Artificial Sequence: Synthetic peptide
KTKPNH

SEQ ID NO: 811 - protein, 6 aa, Artificial Sequence
  Description of Artificial Sequence: Synthetic peptide
KTKPNP

SEQ ID NO: 812 - protein, 6 aa, Artificial Sequence
  Description of Artificial Sequence: Synthetic peptide
KTKPNK

SEQ ID NO: 813 - protein, 5 aa, Artificial Sequence
  Description of Artificial Sequence: Synthetic peptide
KTKPY

SEQ ID NO: 814 - protein, 6 aa, Artificial Sequence
  Description of Artificial Sequence: Synthetic peptide
KTKPYR

SEQ ID NO: 815 - protein, 6 aa, Artificial Sequence
  Description of Artificial Sequence: Synthetic peptide
KTKPYF

SEQ ID NO: 816 - protein, 6 aa, Artificial Sequence
  Description of Artificial Sequence: Synthetic peptide
KTKPYY

SEQ ID NO: 817 - protein, 6 aa, Artificial Sequence
  Description of Artificial Sequence: Synthetic peptide
KTKPYH

SEQ ID NO: 818 - protein, 6 aa, Artificial Sequence
  Description of Artificial Sequence: Synthetic peptide
KTKPYP

SEQ ID NO: 819 - protein, 6 aa, Artificial Sequence
  Description of Artificial Sequence: Synthetic peptide
KTKPYK

SEQ ID NO: 820 - protein, 5 aa, Artificial Sequence
  Description of Artificial Sequence: Synthetic peptide
KTKPR

SEQ ID NO: 821 - protein, 6 aa, Artificial Sequence
  Description of Artificial Sequence: Synthetic peptide
KTKPRR

SEQ ID NO: 822 - protein, 6 aa, Artificial Sequence
  Description of Artificial Sequence: Synthetic peptide
KTKPRF

SEQ ID NO: 823 - protein, 6 aa, Artificial Sequence
  Description of Artificial Sequence: Synthetic peptide
KTKPRY

SEQ ID NO: 824 - protein, 6 aa, Artificial Sequence
  Description of Artificial Sequence: Synthetic peptide
KTKPRH

SEQ ID NO: 825 - protein, 6 aa, Artificial Sequence
  Description of Artificial Sequence: Synthetic peptide
KTKPRP

SEQ ID NO: 826 - protein, 6 aa, Artificial Sequence
  Description of Artificial Sequence: Synthetic peptide
KTKPRK

SEQ ID NO: 827 - protein, 5 aa, Artificial Sequence
  Description of Artificial Sequence: Synthetic peptide
GTKPR

SEQ ID NO: 828 - protein, 5 aa, Artificial Sequence
  Description of Artificial Sequence: Synthetic peptide
GTKPF

SEQ ID NO: 829 - protein, 5 aa, Artificial Sequence
  Description of Artificial Sequence: Synthetic peptide
GTKPY

SEQ ID NO: 830 - protein, 5 aa, Artificial Sequence
  Description of Artificial Sequence: Synthetic peptide
GTKPG

SEQ ID NO: 831 - protein, 5 aa, Artificial Sequence
  Description of Artificial Sequence: Synthetic peptide
GTKPH

SEQ ID NO: 832 - protein, 5 aa, Artificial Sequence
  Description of Artificial Sequence: Synthetic peptide
GTKPK

SEQ ID NO: 833 - protein, 5 aa, Artificial Sequence
  Description of Artificial Sequence: Synthetic peptide
GTKPG

SEQ ID NO: 834 - protein, 6 aa, Artificial Sequence
  Description of Artificial Sequence: Synthetic peptide
GTKPGR

SEQ ID NO: 835 - protein, 6 aa, Artificial Sequence
  Description of Artificial Sequence: Synthetic peptide
GTKPGF

SEQ ID NO: 836 - protein, 6 aa, Artificial Sequence
  Description of Artificial Sequence: Synthetic peptide
GTKPGY

SEQ ID NO: 837 - protein, 6 aa, Artificial Sequence
  Description of Artificial Sequence: Synthetic peptide
GTKPGH

SEQ ID NO: 838 - protein, 6 aa, Artificial Sequence
  Description of Artificial Sequence: Synthetic peptide
GTKPGP

SEQ ID NO: 839 - protein, 6 aa, Artificial Sequence
  Description of Artificial Sequence: Synthetic peptide
GTKPGK

SEQ ID NO: 840 - protein, 5 aa, Artificial Sequence
  Description of Artificial Sequence: Synthetic peptide
GTKPD

SEQ ID NO: 841 - protein, 6 aa, Artificial Sequence
  Description of Artificial Sequence: Synthetic peptide
GTKPDR

SEQ ID NO: 842 - protein, 6 aa, Artificial Sequence
  Description of Artificial Sequence: Synthetic peptide
GTKPDF

SEQ ID NO: 843 - protein, 6 aa, Artificial Sequence
  Description of Artificial Sequence: Synthetic peptide
GTKPDY

SEQ ID NO: 844 - protein, 6 aa, Artificial Sequence
  Description of Artificial Sequence: Synthetic peptide
GTKPDH

SEQ ID NO: 845 - protein, 6 aa, Artificial Sequence
  Description of Artificial Sequence: Synthetic peptide
GTKPDP

SEQ ID NO: 846 - protein, 6 aa, Artificial Sequence
  Description of Artificial Sequence: Synthetic peptide
GTKPDK

SEQ ID NO: 847 - protein, 5 aa, Artificial Sequence
  Description of Artificial Sequence: Synthetic peptide
GTKPW

SEQ ID NO: 848 - protein, 6 aa, Artificial Sequence
  Description of Artificial Sequence: Synthetic peptide
GTKPWR

SEQ ID NO: 849 - protein, 6 aa, Artificial Sequence
  Description of Artificial Sequence: Synthetic peptide
GTKPWF

SEQ ID NO: 850 - protein, 6 aa, Artificial Sequence
  Description of Artificial Sequence: Synthetic peptide
GTKPWY

SEQ ID NO: 851 - protein, 6 aa, Artificial Sequence
  Description of Artificial Sequence: Synthetic peptide
GTKPWH

SEQ ID NO: 852 - protein, 6 aa, Artificial Sequence
  Description of Artificial Sequence: Synthetic peptide
GTKPWP

SEQ ID NO: 853 - protein, 6 aa, Artificial Sequence
  Description of Artificial Sequence: Synthetic peptide
GTKPWK

SEQ ID NO: 854 - protein, 5 aa, Artificial Sequence
  Description of Artificial Sequence: Synthetic peptide
GTKPQ

SEQ ID NO: 855 - protein, 6 aa, Artificial Sequence
  Description of Artificial Sequence: Synthetic peptide
GTKPQR

SEQ ID NO: 856 - protein, 6 aa, Artificial Sequence
  Description of Artificial Sequence: Synthetic peptide
GTKPQF

SEQ ID NO: 857 - protein, 6 aa, Artificial Sequence
  Description of Artificial Sequence: Synthetic peptide
GTKPQY

SEQ ID NO: 858 - protein, 6 aa, Artificial Sequence
  Description of Artificial Sequence: Synthetic peptide
GTKPQH

SEQ ID NO: 859 - protein, 6 aa, Artificial Sequence
  Description of Artificial Sequence: Synthetic peptide
GTKPQP

SEQ ID NO: 860 - protein, 6 aa, Artificial Sequence
  Description of Artificial Sequence: Synthetic peptide
GTKPQK

SEQ ID NO: 861 - protein, 5 aa, Artificial Sequence
  Description of Artificial Sequence: Synthetic peptide
GTKPN

SEQ ID NO: 862 - protein, 6 aa, Artificial Sequence
  Description of Artificial Sequence: Synthetic peptide
GTKPNR

SEQ ID NO: 863 - protein, 6 aa, Artificial Sequence
  Description of Artificial Sequence: Synthetic peptide
GTKPNF

SEQ ID NO: 864 - protein, 6 aa, Artificial Sequence
  Description of Artificial Sequence: Synthetic peptide
GTKPNY

SEQ ID NO: 865 - protein, 6 aa, Artificial Sequence
  Description of Artificial Sequence: Synthetic peptide
GTKPNH

SEQ ID NO: 866 - protein, 6 aa, Artificial Sequence
  Description of Artificial Sequence: Synthetic peptide
GTKPNP

SEQ ID NO: 867 - protein, 6 aa, Artificial Sequence
  Description of Artificial Sequence: Synthetic peptide
GTKPNK

SEQ ID NO: 868 - protein, 5 aa, Artificial Sequence
  Description of Artificial Sequence: Synthetic peptide
GTKPY

SEQ ID NO: 869 - protein, 6 aa, Artificial Sequence
  Description of Artificial Sequence: Synthetic peptide
GTKPYR

SEQ ID NO: 870 - protein, 6 aa, Artificial Sequence
  Description of Artificial Sequence: Synthetic peptide
GTKPYF

SEQ ID NO: 871 - protein, 6 aa, Artificial Sequence
  Description of Artificial Sequence: Synthetic peptide
GTKPYY

SEQ ID NO: 872 - protein, 6 aa, Artificial Sequence
  Description of Artificial Sequence: Synthetic peptide
GTKPYH

SEQ ID NO: 873 - protein, 6 aa, Artificial Sequence
  Description of Artificial Sequence: Synthetic peptide
GTKPYP

SEQ ID NO: 874 - protein, 6 aa, Artificial Sequence
  Description of Artificial Sequence: Synthetic peptide
GTKPYK

SEQ ID NO: 875 - protein, 5 aa, Artificial Sequence
  Description of Artificial Sequence: Synthetic peptide
GTKPR

SEQ ID NO: 876 - protein, 6 aa, Artificial Sequence
  Description of Artificial Sequence: Synthetic peptide
GTKPRR

SEQ ID NO: 877 - protein, 6 aa, Artificial Sequence
  Description of Artificial Sequence: Synthetic peptide
GTKPRF

SEQ ID NO: 878 - protein, 6 aa, Artificial Sequence
  Description of Artificial Sequence: Synthetic peptide
GTKPRY

SEQ ID NO: 879 - protein, 6 aa, Artificial Sequence
  Description of Artificial Sequence: Synthetic peptide
GTKPRH

SEQ ID NO: 880 - protein, 6 aa, Artificial Sequence
  Description of Artificial Sequence: Synthetic peptide
GTKPRP

SEQ ID NO: 881 - protein, 6 aa, Artificial Sequence
  Description of Artificial Sequence: Synthetic peptide
GTKPRK

SEQ ID NO: 882 - protein, 5 aa, Artificial Sequence
  Description of Artificial Sequence: Synthetic peptide
TKPRV

SEQ ID NO: 883 - protein, 5 aa, Artificial Sequence
  Description of Artificial Sequence: Synthetic peptide
TKPFV

SEQ ID NO: 884 - protein, 5 aa, Artificial Sequence
  Description of Artificial Sequence: Synthetic peptide
TKPYV

SEQ ID NO: 885 - protein, 5 aa, Artificial Sequence
  Description of Artificial Sequence: Synthetic peptide
TKPGV

SEQ ID NO: 886 - protein, 5 aa, Artificial Sequence
  Description of Artificial Sequence: Synthetic peptide
TKPHV

SEQ ID NO: 887 - protein, 5 aa, Artificial Sequence
  Description of Artificial Sequence: Synthetic peptide
TKPKV

SEQ ID NO: 888 - protein, 5 aa, Artificial Sequence
  Description of Artificial Sequence: Synthetic peptide
TKPGV

SEQ ID NO: 889 - protein, 6 aa, Artificial Sequence
  Description of Artificial Sequence: Synthetic peptide
TKPGRV

SEQ ID NO: 890 - protein, 6 aa, Artificial Sequence
  Description of Artificial Sequence: Synthetic peptide
TKPGFV

SEQ ID NO: 891 - protein, 6 aa, Artificial Sequence
  Description of Artificial Sequence: Synthetic peptide
TKPGYV

SEQ ID NO: 892 - protein, 6 aa, Artificial Sequence
  Description of Artificial Sequence: Synthetic peptide
TKPGHV

SEQ ID NO: 893 - protein, 6 aa, Artificial Sequence
  Description of Artificial Sequence: Synthetic peptide
TKPGPV

SEQ ID NO: 894 - protein, 6 aa, Artificial Sequence
  Description of Artificial Sequence: Synthetic peptide
TKPGKV

SEQ ID NO: 895 - protein, 5 aa, Artificial Sequence
  Description of Artificial Sequence: Synthetic peptide
TKPDV

SEQ ID NO: 896 - protein, 6 aa, Artificial Sequence
  Description of Artificial Sequence: Synthetic peptide
TKPDRV

SEQ ID NO: 897 - protein, 6 aa, Artificial Sequence
  Description of Artificial Sequence: Synthetic peptide
TKPDFV

SEQ ID NO: 898 - protein, 6 aa, Artificial Sequence
  Description of Artificial Sequence: Synthetic peptide
TKPDYV

SEQ ID NO: 899 - protein, 6 aa, Artificial Sequence
  Description of Artificial Sequence: Synthetic peptide
TKPDHV

SEQ ID NO: 900 - protein, 6 aa, Artificial Sequence
  Description of Artificial Sequence: Synthetic peptide
TKPDPV

SEQ ID NO: 901 - protein, 6 aa, Artificial Sequence
  Description of Artificial Sequence: Synthetic peptide
TKPDKV

SEQ ID NO: 902 - protein, 5 aa, Artificial Sequence
  Description of Artificial Sequence: Synthetic peptide
TKPWV

SEQ ID NO: 903 - protein, 6 aa, Artificial Sequence
  Description of Artificial Sequence: Synthetic peptide
TKPWRV

SEQ ID NO: 904 - protein, 6 aa, Artificial Sequence
  Description of Artificial Sequence: Synthetic peptide
TKPWFV

SEQ ID NO: 905 - protein, 6 aa, Artificial Sequence
  Description of Artificial Sequence: Synthetic peptide
TKPWYV

SEQ ID NO: 906 - protein, 6 aa, Artificial Sequence
  Description of Artificial Sequence: Synthetic peptide
TKPWHV

SEQ ID NO: 907 - protein, 6 aa, Artificial Sequence
  Description of Artificial Sequence: Synthetic peptide
TKPWPV

SEQ ID NO: 908 - protein, 6 aa, Artificial Sequence
  Description of Artificial Sequence: Synthetic peptide
TKPWKV

SEQ ID NO: 909 - protein, 5 aa, Artificial Sequence
  Description of Artificial Sequence: Synthetic peptide
TKPQV

SEQ ID NO: 910 - protein, 6 aa, Artificial Sequence
  Description of Artificial Sequence: Synthetic peptide
TKPQRV

SEQ ID NO: 911 - protein, 6 aa, Artificial Sequence
  Description of Artificial Sequence: Synthetic peptide
TKPQFV

SEQ ID NO: 912 - protein, 6 aa, Artificial Sequence
  Description of Artificial Sequence: Synthetic peptide
TKPQYV

SEQ ID NO: 913 - protein, 6 aa, Artificial Sequence
  Description of Artificial Sequence: Synthetic peptide
TKPQHV

SEQ ID NO: 914 - protein, 6 aa, Artificial Sequence
  Description of Artificial Sequence: Synthetic peptide
TKPQPV

SEQ ID NO: 915 - protein, 6 aa, Artificial Sequence
  Description of Artificial Sequence: Synthetic peptide
TKPQKV

SEQ ID NO: 916 - protein, 5 aa, Artificial Sequence
  Description of Artificial Sequence: Synthetic peptide
TKPNV

SEQ ID NO: 917 - protein, 6 aa, Artificial Sequence
  Description of Artificial Sequence: Synthetic peptide
TKPNRV

SEQ ID NO: 918 - protein, 6 aa, Artificial Sequence
  Description of Artificial Sequence: Synthetic peptide
TKPNFV

SEQ ID NO: 919 - protein, 6 aa, Artificial Sequence
  Description of Artificial Sequence: Synthetic peptide
TKPNYV

SEQ ID NO: 920 - protein, 6 aa, Artificial Sequence
  Description of Artificial Sequence: Synthetic peptide
TKPNHV

SEQ ID NO: 921 - protein, 6 aa, Artificial Sequence
  Description of Artificial Sequence: Synthetic peptide
TKPNPV

SEQ ID NO: 922 - protein, 6 aa, Artificial Sequence
  Description of Artificial Sequence: Synthetic peptide
TKPNKV

SEQ ID NO: 923 - protein, 5 aa, Artificial Sequence
  Description of Artificial Sequence: Synthetic peptide
TKPYV

SEQ ID NO: 924 - protein, 6 aa, Artificial Sequence
  Description of Artificial Sequence: Synthetic peptide
TKPYRV

SEQ ID NO: 925 - protein, 6 aa, Artificial Sequence
  Description of Artificial Sequence: Synthetic peptide
TKPYFV

SEQ ID NO: 926 - protein, 6 aa, Artificial Sequence
  Description of Artificial Sequence: Synthetic peptide
TKPYYV

SEQ ID NO: 927 - protein, 6 aa, Artificial Sequence
  Description of Artificial Sequence: Synthetic peptide
TKPYHV

SEQ ID NO: 928 - protein, 6 aa, Artificial Sequence
  Description of Artificial Sequence: Synthetic peptide
TKPYPV

SEQ ID NO: 929 - protein, 6 aa, Artificial Sequence
  Description of Artificial Sequence: Synthetic peptide
TKPYKV

SEQ ID NO: 930 - protein, 5 aa, Artificial Sequence
  Description of Artificial Sequence: Synthetic peptide
TKPRV

SEQ ID NO: 931 - protein, 6 aa, Artificial Sequence
  Description of Artificial Sequence: Synthetic peptide
TKPRRV

SEQ ID NO: 932 - protein, 6 aa, Artificial Sequence
  Description of Artificial Sequence: Synthetic peptide
TKPRFV

SEQ ID NO: 933 - protein, 6 aa, Artificial Sequence
  Description of Artificial Sequence: Synthetic peptide
TKPRYV

SEQ ID NO: 934 - protein, 6 aa, Artificial Sequence
  Description of Artificial Sequence: Synthetic peptide
TKPRHV

SEQ ID NO: 935 - protein, 6 aa, Artificial Sequence
  Description of Artificial Sequence: Synthetic peptide
TKPRPV

SEQ ID NO: 936 - protein, 6 aa, Artificial Sequence
  Description of Artificial Sequence: Synthetic peptide
TKPRKV

SEQ ID NO: 937 - protein, 5 aa, Artificial Sequence
  Description of Artificial Sequence: Synthetic peptide
MTKPV

SEQ ID NO: 938 - protein, 6 aa, Artificial Sequence
  Description of Artificial Sequence: Synthetic peptide
MTKPRV

SEQ ID NO: 939 - protein, 6 aa, Artificial Sequence
  Description of Artificial Sequence: Synthetic peptide
MTKPFV

SEQ ID NO: 940 - protein, 6 aa, Artificial Sequence
  Description of Artificial Sequence: Synthetic peptide
MTKPYV

SEQ ID NO: 941 - protein, 6 aa, Artificial Sequence
  Description of Artificial Sequence: Synthetic peptide
MTKPHV

SEQ ID NO: 942 - protein, 6 aa, Artificial Sequence
  Description of Artificial Sequence: Synthetic peptide
MTKPKV

SEQ ID NO: 943 - protein, 6 aa, Artificial Sequence
  Description of Artificial Sequence: Synthetic peptide
MTKPGV

SEQ ID NO: 944 - protein, 7 aa, Artificial Sequence
  Description of Artificial Sequence: Synthetic peptide
MTKPGRV

SEQ ID NO: 945 - protein, 7 aa, Artificial Sequence
  Description of Artificial Sequence: Synthetic peptide
MTKPGFV

SEQ ID NO: 946 - protein, 7 aa, Artificial Sequence
  Description of Artificial Sequence: Synthetic peptide
MTKPGYV

SEQ ID NO: 947 - protein, 7 aa, Artificial Sequence
  Description of Artificial Sequence: Synthetic peptide
MTKPGHV

SEQ ID NO: 948 - protein, 7 aa, Artificial Sequence
  Description of Artificial Sequence: Synthetic peptide
MTKPGPV

SEQ ID NO: 949 - protein, 7 aa, Artificial Sequence
  Description of Artificial Sequence: Synthetic peptide
MTKPGKV

SEQ ID NO: 950 - protein, 6 aa, Artificial Sequence
  Description of Artificial Sequence: Synthetic peptide
MTKPDV

SEQ ID NO: 951 - protein, 7 aa, Artificial Sequence
  Description of Artificial Sequence: Synthetic peptide
MTKPDRV

SEQ ID NO: 952 - protein, 7 aa, Artificial Sequence
  Description of Artificial Sequence: Synthetic peptide
MTKPDFV

SEQ ID NO: 953 - protein, 7 aa, Artificial Sequence
  Description of Artificial Sequence: Synthetic peptide
MTKPDYV

SEQ ID NO: 954 - protein, 7 aa, Artificial Sequence
  Description of Artificial Sequence: Synthetic peptide
MTKPDHV

SEQ ID NO: 955 - protein, 7 aa, Artificial Sequence
  Description of Artificial Sequence: Synthetic peptide
MTKPDPV

SEQ ID NO: 956 - protein, 7 aa, Artificial Sequence
  Description of Artificial Sequence: Synthetic peptide
MTKPDKV

SEQ ID NO: 957 - protein, 6 aa, Artificial Sequence
  Description of Artificial Sequence: Synthetic peptide
MTKPWV

SEQ ID NO: 958 - protein, 7 aa, Artificial Sequence
  Description of Artificial Sequence: Synthetic peptide
MTKPWRV

SEQ ID NO: 959 - protein, 7 aa, Artificial Sequence
  Description of Artificial Sequence: Synthetic peptide
MTKPWFV

SEQ ID NO: 960 - protein, 7 aa, Artificial Sequence
  Description of Artificial Sequence: Synthetic peptide
MTKPWYV

SEQ ID NO: 961 - protein, 7 aa, Artificial Sequence
  Description of Artificial Sequence: Synthetic peptide
MTKPWHV

SEQ ID NO: 962 - protein, 7 aa, Artificial Sequence
  Description of Artificial Sequence: Synthetic peptide
MTKPWPV

SEQ ID NO: 963 - protein, 7 aa, Artificial Sequence
  Description of Artificial Sequence: Synthetic peptide
MTKPWKV

SEQ ID NO: 964 - protein, 6 aa, Artificial Sequence
  Description of Artificial Sequence: Synthetic peptide
MTKPQV

SEQ ID NO: 965 - protein, 7 aa, Artificial Sequence
  Description of Artificial Sequence: Synthetic peptide
MTKPQRV

SEQ ID NO: 966 - protein, 7 aa, Artificial Sequence
  Description of Artificial Sequence: Synthetic peptide
MTKPQFV

SEQ ID NO: 967 - protein, 7 aa, Artificial Sequence
  Description of Artificial Sequence: Synthetic peptide
MTKPQYV

SEQ ID NO: 968 - protein, 7 aa, Artificial Sequence
  Description of Artificial Sequence: Synthetic peptide
MTKPQHV

SEQ ID NO: 969 - protein, 7 aa, Artificial Sequence
  Description of Artificial Sequence: Synthetic peptide
MTKPQPV

SEQ ID NO: 970 - protein, 7 aa, Artificial Sequence
  Description of Artificial Sequence: Synthetic peptide
MTKPQKV

SEQ ID NO: 971 - protein, 6 aa, Artificial Sequence
  Description of Artificial Sequence: Synthetic peptide
MTKPNV

SEQ ID NO: 972 - protein, 7 aa, Artificial Sequence
  Description of Artificial Sequence: Synthetic peptide
MTKPNRV

SEQ ID NO: 973 - protein, 7 aa, Artificial Sequence
  Description of Artificial Sequence: Synthetic peptide
MTKPNFV

SEQ ID NO: 974 - protein, 7 aa, Artificial Sequence
  Description of Artificial Sequence: Synthetic peptide
MTKPNYV

SEQ ID NO: 975 - protein, 7 aa, Artificial Sequence
  Description of Artificial Sequence: Synthetic peptide
MTKPNHV

SEQ ID NO: 976 - protein, 7 aa, Artificial Sequence
  Description of Artificial Sequence: Synthetic peptide
MTKPNPV

SEQ ID NO: 977 - protein, 7 aa, Artificial Sequence
  Description of Artificial Sequence: Synthetic peptide
MTKPNKV

SEQ ID NO: 978 - protein, 6 aa, Artificial Sequence
  Description of Artificial Sequence: Synthetic peptide
MTKPYV

SEQ ID NO: 979 - protein, 7 aa, Artificial Sequence
  Description of Artificial Sequence: Synthetic peptide
MTKPYRV

SEQ ID NO: 980 - protein, 7 aa, Artificial Sequence
  Description of Artificial Sequence: Synthetic peptide
MTKPYFV

SEQ ID NO: 981 - protein, 7 aa, Artificial Sequence
  Description of Artificial Sequence: Synthetic peptide
MTKPYYV

SEQ ID NO: 982 - protein, 7 aa, Artificial Sequence
  Description of Artificial Sequence: Synthetic peptide
MTKPYHV

SEQ ID NO: 983 - protein, 7 aa, Artificial Sequence
  Description of Artificial Sequence: Synthetic peptide
MTKPYPV

SEQ ID NO: 984 - protein, 7 aa, Artificial Sequence
  Description of Artificial Sequence: Synthetic peptide
MTKPYKV

SEQ ID NO: 985 - protein, 6 aa, Artificial Sequence
  Description of Artificial Sequence: Synthetic peptide
MTKPRV

SEQ ID NO: 986 - protein, 7 aa, Artificial Sequence
  Description of Artificial Sequence: Synthetic peptide
MTKPRRV

SEQ ID NO: 987 - protein, 7 aa, Artificial Sequence
  Description of Artificial Sequence: Synthetic peptide
MTKPRFV

SEQ ID NO: 988 - protein, 7 aa, Artificial Sequence
  Description of Artificial Sequence: Synthetic peptide
MTKPRYV

SEQ ID NO: 989 - protein, 7 aa, Artificial Sequence
  Description of Artificial Sequence: Synthetic peptide
MTKPRHV

SEQ ID NO: 990 - protein, 7 aa, Artificial Sequence
  Description of Artificial Sequence: Synthetic peptide
MTKPRPV

SEQ ID NO: 991 - protein, 7 aa, Artificial Sequence
  Description of Artificial Sequence: Synthetic peptide
MTKPRKV

SEQ ID NO: 992 - protein, 5 aa, Artificial Sequence
  Description of Artificial Sequence: Synthetic peptide
MTKPV

SEQ ID NO: 993 - protein, 6 aa, Artificial Sequence
  Description of Artificial Sequence: Synthetic peptide
MTKPRV

SEQ ID NO: 994 - protein, 6 aa, Artificial Sequence
  Description of Artificial Sequence: Synthetic peptide
MTKPFV

SEQ ID NO: 995 - protein, 6 aa, Artificial Sequence
  Description of Artificial Sequence: Synthetic peptide
MTKPYV

SEQ ID NO: 996 - protein, 6 aa, Artificial Sequence
  Description of Artificial Sequence: Synthetic peptide
MTKPGV

SEQ ID NO: 997 - protein, 6 aa, Artificial Sequence
  Description of Artificial Sequence: Synthetic peptide
MTKPHV

SEQ ID NO: 998 - protein, 6 aa, Artificial Sequence
  Description of Artificial Sequence: Synthetic peptide
MTKPKV

SEQ ID NO: 999 - protein, 6 aa, Artificial Sequence
  Description of Artificial Sequence: Synthetic peptide
MTKPGV

SEQ ID NO: 1000 - protein, 7 aa, Artificial Sequence
  Description of Artificial Sequence: Synthetic peptide
MTKPGRV

SEQ ID NO: 1001 - protein, 7 aa, Artificial Sequence
  Description of Artificial Sequence: Synthetic peptide
MTKPGFV

SEQ ID NO: 1002 - protein, 7 aa, Artificial Sequence
  Description of Artificial Sequence: Synthetic peptide
MTKPGYV

SEQ ID NO: 1003 - protein, 7 aa, Artificial Sequence
  Description of Artificial Sequence: Synthetic peptide
MTKPGHV

SEQ ID NO: 1004 - protein, 7 aa, Artificial Sequence
  Description of Artificial Sequence: Synthetic peptide
MTKPGPV

SEQ ID NO: 1005 - protein, 7 aa, Artificial Sequence
  Description of Artificial Sequence: Synthetic peptide
MTKPGKV

SEQ ID NO: 1006 - protein, 6 aa, Artificial Sequence
  Description of Artificial Sequence: Synthetic peptide
MTKPDV

SEQ ID NO: 1007 - protein, 7 aa, Artificial Sequence
  Description of Artificial Sequence: Synthetic peptide
MTKPDRV

SEQ ID NO: 1008 - protein, 7 aa, Artificial Sequence
  Description of Artificial Sequence: Synthetic peptide
MTKPDFV

SEQ ID NO: 1009 - protein, 7 aa, Artificial Sequence
  Description of Artificial Sequence: Synthetic peptide
MTKPDYV

SEQ ID NO: 1010 - protein, 7 aa, Artificial Sequence
  Description of Artificial Sequence: Synthetic peptide
MTKPDHV

SEQ ID NO: 1011 - protein, 7 aa, Artificial Sequence
  Description of Artificial Sequence: Synthetic peptide
MTKPDPV

SEQ ID NO: 1012 - protein, 7 aa, Artificial Sequence
  Description of Artificial Sequence: Synthetic peptide
MTKPDKV

SEQ ID NO: 1013 - protein, 6 aa, Artificial Sequence
  Description of Artificial Sequence: Synthetic peptide
MTKPWV

SEQ ID NO: 1014 - protein, 7 aa, Artificial Sequence
  Description of Artificial Sequence: Synthetic peptide
MTKPWRV

SEQ ID NO: 1015 - protein, 7 aa, Artificial Sequence
  Description of Artificial Sequence: Synthetic peptide
MTKPWFV

SEQ ID NO: 1016 - protein, 7 aa, Artificial Sequence
  Description of Artificial Sequence: Synthetic peptide
MTKPWYV

SEQ ID NO: 1017 - protein, 7 aa, Artificial Sequence
  Description of Artificial Sequence: Synthetic peptide
MTKPWHV

SEQ ID NO: 1018 - protein, 7 aa, Artificial Sequence
  Description of Artificial Sequence: Synthetic peptide
MTKPWPV

SEQ ID NO: 1019 - protein, 7 aa, Artificial Sequence
  Description of Artificial Sequence: Synthetic peptide
MTKPWKV

SEQ ID NO: 1020 - protein, 6 aa, Artificial Sequence
  Description of Artificial Sequence: Synthetic peptide
MTKPQV

SEQ ID NO: 1021 - protein, 7 aa, Artificial Sequence
  Description of Artificial Sequence: Synthetic peptide
MTKPQRV

SEQ ID NO: 1022 - protein, 7 aa, Artificial Sequence
  Description of Artificial Sequence: Synthetic peptide
MTKPQFV

SEQ ID NO: 1023 - protein, 7 aa, Artificial Sequence
  Description of Artificial Sequence: Synthetic peptide
MTKPQYV

SEQ ID NO: 1024 - protein, 7 aa, Artificial Sequence
  Description of Artificial Sequence: Synthetic peptide
MTKPQHV

SEQ ID NO: 1025 - protein, 7 aa, Artificial Sequence
  Description of Artificial Sequence: Synthetic peptide
MTKPQPV

SEQ ID NO: 1026 - protein, 7 aa, Artificial Sequence
  Description of Artificial Sequence: Synthetic peptide
MTKPQKV

SEQ ID NO: 1027 - protein, 6 aa, Artificial Sequence
  Description of Artificial Sequence: Synthetic peptide
MTKPNV

SEQ ID NO: 1028 - protein, 7 aa, Artificial Sequence
  Description of Artificial Sequence: Synthetic peptide
MTKPNRV

SEQ ID NO: 1029 - protein, 7 aa, Artificial Sequence
  Description of Artificial Sequence: Synthetic peptide
MTKPNFV

SEQ ID NO: 1030 - protein, 7 aa, Artificial Sequence
  Description of Artificial Sequence: Synthetic peptide
MTKPNYV

SEQ ID NO: 1031 - protein, 7 aa, Artificial Sequence
  Description of Artificial Sequence: Synthetic peptide
MTKPNHV

SEQ ID NO: 1032 - protein, 7 aa, Artificial Sequence
  Description of Artificial Sequence: Synthetic peptide
MTKPNPV

SEQ ID NO: 1033 - protein, 7 aa, Artificial Sequence
  Description of Artificial Sequence: Synthetic peptide
MTKPNKV

SEQ ID NO: 1034 - protein, 6 aa, Artificial Sequence
  Description of Artificial Sequence: Synthetic peptide
MTKPYV

SEQ ID NO: 1035 - protein, 7 aa, Artificial Sequence
  Description of Artificial Sequence: Synthetic peptide
MTKPYRV

SEQ ID NO: 1036 - protein, 7 aa, Artificial Sequence
  Description of Artificial Sequence: Synthetic peptide
MTKPYFV

SEQ ID NO: 1037 - protein, 7 aa, Artificial Sequence
  Description of Artificial Sequence: Synthetic peptide
MTKPYYV

SEQ ID NO: 1038 - protein, 7 aa, Artificial Sequence
  Description of Artificial Sequence: Synthetic peptide
MTKPYHV

SEQ ID NO: 1039 - protein, 7 aa, Artificial Sequence
  Description of Artificial Sequence: Synthetic peptide
MTKPYPV

SEQ ID NO: 1040 - protein, 7 aa, Artificial Sequence
  Description of Artificial Sequence: Synthetic peptide
MTKPYKV

SEQ ID NO: 1041 - protein, 6 aa, Artificial Sequence
  Description of Artificial Sequence: Synthetic peptide
MTKPRV

SEQ ID NO: 1042 - protein, 7 aa, Artificial Sequence
  Description of Artificial Sequence: Synthetic peptide
MTKPRRV

SEQ ID NO: 1043 - protein, 7 aa, Artificial Sequence
  Description of Artificial Sequence: Synthetic peptide
MTKPRFV

SEQ ID NO: 1044 - protein, 7 aa, Artificial Sequence
  Description of Artificial Sequence: Synthetic peptide
MTKPRYV

SEQ ID NO: 1045 - protein, 7 aa, Artificial Sequence
  Description of Artificial Sequence: Synthetic peptide
MTKPRHV

SEQ ID NO: 1046 - protein, 7 aa, Artificial Sequence
  Description of Artificial Sequence: Synthetic peptide
MTKPRPV

SEQ ID NO: 1047 - protein, 7 aa, Artificial Sequence
  Description of Artificial Sequence: Synthetic peptide
MTKPRKV

SEQ ID NO: 1048 - protein, 5 aa, Artificial Sequence
  Description of Artificial Sequence: Synthetic peptide
TTKPV

SEQ ID NO: 1049 - protein, 6 aa, Artificial Sequence
  Description of Artificial Sequence: Synthetic peptide
TTKPRV

SEQ ID NO: 1050 - protein, 6 aa, Artificial Sequence
  Description of Artificial Sequence: Synthetic peptide
TTKPFV

SEQ ID NO: 1051 - protein, 6 aa, Artificial Sequence
  Description of Artificial Sequence: Synthetic peptide
TTKPYV

SEQ ID NO: 1052 - protein, 6 aa, Artificial Sequence
  Description of Artificial Sequence: Synthetic peptide
TTKPGV

SEQ ID NO: 1053 - protein, 6 aa, Artificial Sequence
  Description of Artificial Sequence: Synthetic peptide
TTKPHV

SEQ ID NO: 1054 - protein, 6 aa, Artificial Sequence
  Description of Artificial Sequence: Synthetic peptide
TTKPKV

SEQ ID NO: 1055 - protein, 6 aa, Artificial Sequence
  Description of Artificial Sequence: Synthetic peptide
TTKPGV

SEQ ID NO: 1056 - protein, 7 aa, Artificial Sequence
  Description of Artificial Sequence: Synthetic peptide
TTKPGRV

SEQ ID NO: 1057 - protein, 7 aa, Artificial Sequence
  Description of Artificial Sequence: Synthetic peptide
TTKPGFV

SEQ ID NO: 1058 - protein, 7 aa, Artificial Sequence
  Description of Artificial Sequence: Synthetic peptide
TTKPGYV

SEQ ID NO: 1059 - protein, 7 aa, Artificial Sequence
  Description of Artificial Sequence: Synthetic peptide
TTKPGHV

SEQ ID NO: 1060 - protein, 7 aa, Artificial Sequence
  Description of Artificial Sequence: Synthetic peptide
TTKPGPV

SEQ ID NO: 1061 - protein, 7 aa, Artificial Sequence
  Description of Artificial Sequence: Synthetic peptide
TTKPGKV

SEQ ID NO: 1062 - protein, 6 aa, Artificial Sequence
  Description of Artificial Sequence: Synthetic peptide
TTKPDV

SEQ ID NO: 1063 - protein, 7 aa, Artificial Sequence
  Description of Artificial Sequence: Synthetic peptide
TTKPDRV

SEQ ID NO: 1064 - protein, 7 aa, Artificial Sequence
  Description of Artificial Sequence: Synthetic peptide
TTKPDFV

SEQ ID NO: 1065 - protein, 7 aa, Artificial Sequence
  Description of Artificial Sequence: Synthetic peptide
TTKPDYV

SEQ ID NO: 1066 - protein, 7 aa, Artificial Sequence
  Description of Artificial Sequence: Synthetic peptide
TTKPDHV

SEQ ID NO: 1067 - protein, 7 aa, Artificial Sequence
  Description of Artificial Sequence: Synthetic peptide
TTKPDPV

SEQ ID NO: 1068 - protein, 7 aa, Artificial Sequence
  Description of Artificial Sequence: Synthetic peptide
TTKPDKV

SEQ ID NO: 1069 - protein, 6 aa, Artificial Sequence
  Description of Artificial Sequence: Synthetic peptide
TTKPWV

SEQ ID NO: 1070 - protein, 7 aa, Artificial Sequence
  Description of Artificial Sequence: Synthetic peptide
TTKPWRV

SEQ ID NO: 1071 - protein, 7 aa, Artificial Sequence
  Description of Artificial Sequence: Synthetic peptide
TTKPWFV

SEQ ID NO: 1072 - protein, 7 aa, Artificial Sequence
  Description of Artificial Sequence: Synthetic peptide
TTKPWYV

SEQ ID NO: 1073 - protein, 7 aa, Artificial Sequence
  Description of Artificial Sequence: Synthetic peptide
TTKPWHV

SEQ ID NO: 1074 - protein, 7 aa, Artificial Sequence
  Description of Artificial Sequence: Synthetic peptide
TTKPWPV

SEQ ID NO: 1075 - protein, 7 aa, Artificial Sequence
  Description of Artificial Sequence: Synthetic peptide
TTKPWKV

SEQ ID NO: 1076 - protein, 6 aa, Artificial Sequence
  Description of Artificial Sequence: Synthetic peptide
TTKPQV

SEQ ID NO: 1077 - protein, 7 aa, Artificial Sequence
  Description of Artificial Sequence: Synthetic peptide
TTKPQRV

SEQ ID NO: 1078 - protein, 7 aa, Artificial Sequence
  Description of Artificial Sequence: Synthetic peptide
TTKPQFV

SEQ ID NO: 1079 - protein, 7 aa, Artificial Sequence
  Description of Artificial Sequence: Synthetic peptide
TTKPQYV

SEQ ID NO: 1080 - protein, 7 aa, Artificial Sequence
  Description of Artificial Sequence: Synthetic peptide
TTKPQHV

SEQ ID NO: 1081 - protein, 7 aa, Artificial Sequence
  Description of Artificial Sequence: Synthetic peptide
TTKPQPV

SEQ ID NO: 1082 - protein, 7 aa, Artificial Sequence
  Description of Artificial Sequence: Synthetic peptide
TTKPQKV

SEQ ID NO: 1083 - protein, 6 aa, Artificial Sequence
  Description of Artificial Sequence: Synthetic peptide
TTKPNV

SEQ ID NO: 1084 - protein, 7 aa, Artificial Sequence
  Description of Artificial Sequence: Synthetic peptide
TTKPNRV

SEQ ID NO: 1085 - protein, 7 aa, Artificial Sequence
  Description of Artificial Sequence: Synthetic peptide
TTKPNFV

SEQ ID NO: 1086 - protein, 7 aa, Artificial Sequence
  Description of Artificial Sequence: Synthetic peptide
TTKPNYV

SEQ ID NO: 1087 - protein, 7 aa, Artificial Sequence
  Description of Artificial Sequence: Synthetic peptide
TTKPNHV

SEQ ID NO: 1088 - protein, 7 aa, Artificial Sequence
  Description of Artificial Sequence: Synthetic peptide
TTKPNPV

SEQ ID NO: 1089 - protein, 7 aa, Artificial Sequence
  Description of Artificial Sequence: Synthetic peptide
TTKPNKV

SEQ ID NO: 1090 - protein, 6 aa, Artificial Sequence
  Description of Artificial Sequence: Synthetic peptide
TTKPYV

SEQ ID NO: 1091 - protein, 7 aa, Artificial Sequence
  Description of Artificial Sequence: Synthetic peptide
TTKPYRV

SEQ ID NO: 1092 - protein, 7 aa, Artificial Sequence
  Description of Artificial Sequence: Synthetic peptide
TTKPYFV

SEQ ID NO: 1093 - protein, 7 aa, Artificial Sequence
  Description of Artificial Sequence: Synthetic peptide
TTKPYYV

SEQ ID NO: 1094 - protein, 7 aa, Artificial Sequence
  Description of Artificial Sequence: Synthetic peptide
TTKPYHV

SEQ ID NO: 1095 - protein, 7 aa, Artificial Sequence
  Description of Artificial Sequence: Synthetic peptide
TTKPYPV

SEQ ID NO: 1096 - protein, 7 aa, Artificial Sequence
  Description of Artificial Sequence: Synthetic peptide
TTKPYKV

SEQ ID NO: 1097 - protein, 6 aa, Artificial Sequence
  Description of Artificial Sequence: Synthetic peptide
TTKPRV

SEQ ID NO: 1098 - protein, 7 aa, Artificial Sequence
  Description of Artificial Sequence: Synthetic peptide
TTKPRRV

SEQ ID NO: 1099 - protein, 7 aa, Artificial Sequence
  Description of Artificial Sequence: Synthetic peptide
TTKPRFV

SEQ ID NO: 1100 - protein, 7 aa, Artificial Sequence
  Description of Artificial Sequence: Synthetic peptide
TTKPRYV

SEQ ID NO: 1101 - protein, 7 aa, Artificial Sequence
  Description of Artificial Sequence: Synthetic peptide
TTKPRHV

SEQ ID NO: 1102 - protein, 7 aa, Artificial Sequence
  Description of Artificial Sequence: Synthetic peptide
TTKPRPV

SEQ ID NO: 1103 - protein, 7 aa, Artificial Sequence
  Description of Artificial Sequence: Synthetic peptide
TTKPRKV

SEQ ID NO: 1104 - protein, 5 aa, Artificial Sequence
  Description of Artificial Sequence: Synthetic peptide
ATKPV

SEQ ID NO: 1105 - protein, 6 aa, Artificial Sequence
  Description of Artificial Sequence: Synthetic peptide
ATKPRV

SEQ ID NO: 1106 - protein, 6 aa, Artificial Sequence
  Description of Artificial Sequence: Synthetic peptide
ATKPFV

SEQ ID NO: 1107 - protein, 6 aa, Artificial Sequence
  Description of Artificial Sequence: Synthetic peptide
ATKPYV

SEQ ID NO: 1108 - protein, 6 aa, Artificial Sequence
  Description of Artificial Sequence: Synthetic peptide
ATKPGV

SEQ ID NO: 1109 - protein, 6 aa, Artificial Sequence
  Description of Artificial Sequence: Synthetic peptide
ATKPHV

SEQ ID NO: 1110 - protein, 6 aa, Artificial Sequence
  Description of Artificial Sequence: Synthetic peptide
ATKPKV

SEQ ID NO: 1111 - protein, 6 aa, Artificial Sequence
  Description of Artificial Sequence: Synthetic peptide
ATKPGV

SEQ ID NO: 1112 - protein, 7 aa, Artificial Sequence
  Description of Artificial Sequence: Synthetic peptide
ATKPGRV

SEQ ID NO: 1113 - protein, 7 aa, Artificial Sequence
  Description of Artificial Sequence: Synthetic peptide
ATKPGFV

SEQ ID NO: 1114 - protein, 7 aa, Artificial Sequence
  Description of Artificial Sequence: Synthetic peptide
ATKPGYV

SEQ ID NO: 1115 - protein, 7 aa, Artificial Sequence
  Description of Artificial Sequence: Synthetic peptide
ATKPGHV

SEQ ID NO: 1116 - protein, 7 aa, Artificial Sequence
  Description of Artificial Sequence: Synthetic peptide
ATKPGPV

SEQ ID NO: 1117 - protein, 7 aa, Artificial Sequence
  Description of Artificial Sequence: Synthetic peptide
ATKPGKV

SEQ ID NO: 1118 - protein, 6 aa, Artificial Sequence
  Description of Artificial Sequence: Synthetic peptide
ATKPDV

SEQ ID NO: 1119 - protein, 7 aa, Artificial Sequence
  Description of Artificial Sequence: Synthetic peptide
ATKPDRV

SEQ ID NO: 1120 - protein, 7 aa, Artificial Sequence
  Description of Artificial Sequence: Synthetic peptide
ATKPDFV

SEQ ID NO: 1121 - protein, 7 aa, Artificial Sequence
  Description of Artificial Sequence: Synthetic peptide
ATKPDYV

SEQ ID NO: 1122 - protein, 7 aa, Artificial Sequence
  Description of Artificial Sequence: Synthetic peptide
ATKPDHV

SEQ ID NO: 1123 - protein, 7 aa, Artificial Sequence
  Description of Artificial Sequence: Synthetic peptide
ATKPDPV

SEQ ID NO: 1124 - protein, 7 aa, Artificial Sequence
  Description of Artificial Sequence: Synthetic peptide
ATKPDKV

SEQ ID NO: 1125 - protein, 6 aa, Artificial Sequence
  Description of Artificial Sequence: Synthetic peptide
ATKPWV

SEQ ID NO: 1126 - protein, 7 aa, Artificial Sequence
  Description of Artificial Sequence: Synthetic peptide
ATKPWRV

SEQ ID NO: 1127 - protein, 7 aa, Artificial Sequence
  Description of Artificial Sequence: Synthetic peptide
ATKPWFV

SEQ ID NO: 1128 - protein, 7 aa, Artificial Sequence
  Description of Artificial Sequence: Synthetic peptide
ATKPWYV

SEQ ID NO: 1129 - protein, 7 aa, Artificial Sequence
  Description of Artificial Sequence: Synthetic peptide
ATKPWHV

SEQ ID NO: 1130 - protein, 7 aa, Artificial Sequence
  Description of Artificial Sequence: Synthetic peptide
ATKPWPV

SEQ ID NO: 1131 - protein, 7 aa, Artificial Sequence
  Description of Artificial Sequence: Synthetic peptide
ATKPWKV

SEQ ID NO: 1132 - protein, 6 aa, Artificial Sequence
  Description of Artificial Sequence: Synthetic peptide
ATKPQV

SEQ ID NO: 1133 - protein, 7 aa, Artificial Sequence
  Description of Artificial Sequence: Synthetic peptide
ATKPQRV

SEQ ID NO: 1134 - protein, 7 aa, Artificial Sequence
  Description of Artificial Sequence: Synthetic peptide
ATKPQFV

SEQ ID NO: 1135 - protein, 7 aa, Artificial Sequence
  Description of Artificial Sequence: Synthetic peptide
ATKPQYV

SEQ ID NO: 1136 - protein, 7 aa, Artificial Sequence
  Description of Artificial Sequence: Synthetic peptide
ATKPQHV

SEQ ID NO: 1137 - protein, 7 aa, Artificial Sequence
  Description of Artificial Sequence: Synthetic peptide
ATKPQPV

SEQ ID NO: 1138 - protein, 7 aa, Artificial Sequence
  Description of Artificial Sequence: Synthetic peptide
ATKPQKV

SEQ ID NO: 1139 - protein, 6 aa, Artificial Sequence
  Description of Artificial Sequence: Synthetic peptide
ATKPNV

SEQ ID NO: 1140 - protein, 7 aa, Artificial Sequence
  Description of Artificial Sequence: Synthetic peptide
ATKPNRV

SEQ ID NO: 1141 - protein, 7 aa, Artificial Sequence
  Description of Artificial Sequence: Synthetic peptide
ATKPNFV

SEQ ID NO: 1142 - protein, 7 aa, Artificial Sequence
  Description of Artificial Sequence: Synthetic peptide
ATKPNYV

SEQ ID NO: 1143 - protein, 7 aa, Artificial Sequence
  Description of Artificial Sequence: Synthetic peptide
ATKPNHV

SEQ ID NO: 1144 - protein, 7 aa, Artificial Sequence
  Description of Artificial Sequence: Synthetic peptide
ATKPNPV

SEQ ID NO: 1145 - protein, 7 aa, Artificial Sequence
  Description of Artificial Sequence: Synthetic peptide
ATKPNKV

SEQ ID NO: 1146 - protein, 6 aa, Artificial Sequence
  Description of Artificial Sequence: Synthetic peptide
ATKPYV

SEQ ID NO: 1147 - protein, 7 aa, Artificial Sequence
  Description of Artificial Sequence: Synthetic peptide
ATKPYRV

SEQ ID NO: 1148 - protein, 7 aa, Artificial Sequence
  Description of Artificial Sequence: Synthetic peptide
ATKPYFV

SEQ ID NO: 1149 - protein, 7 aa, Artificial Sequence
  Description of Artificial Sequence: Synthetic peptide
ATKPYYV

SEQ ID NO: 1150 - protein, 7 aa, Artificial Sequence
  Description of Artificial Sequence: Synthetic peptide
ATKPYHV

SEQ ID NO: 1151 - protein, 7 aa, Artificial Sequence
  Description of Artificial Sequence: Synthetic peptide
ATKPYPV

SEQ ID NO: 1152 - protein, 7 aa, Artificial Sequence
  Description of Artificial Sequence: Synthetic peptide
ATKPYKV

SEQ ID NO: 1153 - protein, 6 aa, Artificial Sequence
  Description of Artificial Sequence: Synthetic peptide
ATKPRV

SEQ ID NO: 1154 - protein, 7 aa, Artificial Sequence
  Description of Artificial Sequence: Synthetic peptide
ATKPRRV

SEQ ID NO: 1155 - protein, 7 aa, Artificial Sequence
  Description of Artificial Sequence: Synthetic peptide
ATKPRFV

SEQ ID NO: 1156 - protein, 7 aa, Artificial Sequence
  Description of Artificial Sequence: Synthetic peptide
ATKPRYV

SEQ ID NO: 1157 - protein, 7 aa, Artificial Sequence
  Description of Artificial Sequence: Synthetic peptide
ATKPRHV

SEQ ID NO: 1158 - protein, 7 aa, Artificial Sequence
  Description of Artificial Sequence: Synthetic peptide
ATKPRPV

SEQ ID NO: 1159 - protein, 7 aa, Artificial Sequence
  Description of Artificial Sequence: Synthetic peptide
ATKPRKV

SEQ ID NO: 1160 - protein, 5 aa, Artificial Sequence
  Description of Artificial Sequence: Synthetic peptide
HTKPV

SEQ ID NO: 1161 - protein, 6 aa, Artificial Sequence
  Description of Artificial Sequence: Synthetic peptide
HTKPRV

SEQ ID NO: 1162 - protein, 6 aa, Artificial Sequence
  Description of Artificial Sequence: Synthetic peptide
HTKPFV

SEQ ID NO: 1163 - protein, 6 aa, Artificial Sequence
  Description of Artificial Sequence: Synthetic peptide
HTKPYV

SEQ ID NO: 1164 - protein, 6 aa, Artificial Sequence
  Description of Artificial Sequence: Synthetic peptide
HTKPGV

SEQ ID NO: 1165 - protein, 6 aa, Artificial Sequence
  Description of Artificial Sequence: Synthetic peptide
HTKPHV

SEQ ID NO: 1166 - protein, 6 aa, Artificial Sequence
  Description of Artificial Sequence: Synthetic peptide
HTKPKV

SEQ ID NO: 1167 - protein, 6 aa, Artificial Sequence
  Description of Artificial Sequence: Synthetic peptide
HTKPGV

SEQ ID NO: 1168 - protein, 7 aa, Artificial Sequence
  Description of Artificial Sequence: Synthetic peptide
HTKPGRV

SEQ ID NO: 1169 - protein, 7 aa, Artificial Sequence
  Description of Artificial Sequence: Synthetic peptide
HTKPGFV

SEQ ID NO: 1170 - protein, 7 aa, Artificial Sequence
  Description of Artificial Sequence: Synthetic peptide
HTKPGYV

SEQ ID NO: 1171 - protein, 7 aa, Artificial Sequence
  Description of Artificial Sequence: Synthetic peptide
HTKPGHV

SEQ ID NO: 1172 - protein, 7 aa, Artificial Sequence
  Description of Artificial Sequence: Synthetic peptide
HTKPGPV

SEQ ID NO: 1173 - protein, 7 aa, Artificial Sequence
  Description of Artificial Sequence: Synthetic peptide
HTKPGKV

SEQ ID NO: 1174 - protein, 6 aa, Artificial Sequence
  Description of Artificial Sequence: Synthetic peptide
HTKPDV

SEQ ID NO: 1175 - protein, 7 aa, Artificial Sequence
  Description of Artificial Sequence: Synthetic peptide
HTKPDRV

SEQ ID NO: 1176 - protein, 7 aa, Artificial Sequence
  Description of Artificial Sequence: Synthetic peptide
HTKPDFV

SEQ ID NO: 1177 - protein, 7 aa, Artificial Sequence
  Description of Artificial Sequence: Synthetic peptide
HTKPDYV

SEQ ID NO: 1178 - protein, 7 aa, Artificial Sequence
  Description of Artificial Sequence: Synthetic peptide
HTKPDHV

SEQ ID NO: 1179 - protein, 7 aa, Artificial Sequence
  Description of Artificial Sequence: Synthetic peptide
HTKPDPV

SEQ ID NO: 1180 - protein, 7 aa, Artificial Sequence
  Description of Artificial Sequence: Synthetic peptide
HTKPDKV

SEQ ID NO: 1181 - protein, 6 aa, Artificial Sequence
  Description of Artificial Sequence: Synthetic peptide
HTKPWV

SEQ ID NO: 1182 - protein, 7 aa, Artificial Sequence
  Description of Artificial Sequence: Synthetic peptide
HTKPWRV

SEQ ID NO: 1183 - protein, 7 aa, Artificial Sequence
  Description of Artificial Sequence: Synthetic peptide
HTKPWFV

SEQ ID NO: 1184 - protein, 7 aa, Artificial Sequence
  Description of Artificial Sequence: Synthetic peptide
HTKPWYV

SEQ ID NO: 1185 - protein, 7 aa, Artificial Sequence
  Description of Artificial Sequence: Synthetic peptide
HTKPWHV

SEQ ID NO: 1186 - protein, 7 aa, Artificial Sequence
  Description of Artificial Sequence: Synthetic peptide
HTKPWPV

SEQ ID NO: 1187 - protein, 7 aa, Artificial Sequence
  Description of Artificial Sequence: Synthetic peptide
HTKPWKV

SEQ ID NO: 1188 - protein, 6 aa, Artificial Sequence
  Description of Artificial Sequence: Synthetic peptide
HTKPQV

SEQ ID NO: 1189 - protein, 7 aa, Artificial Sequence
  Description of Artificial Sequence: Synthetic peptide
HTKPQRV

SEQ ID NO: 1190 - protein, 7 aa, Artificial Sequence
  Description of Artificial Sequence: Synthetic peptide
HTKPQFV

SEQ ID NO: 1191 - protein, 7 aa, Artificial Sequence
  Description of Artificial Sequence: Synthetic peptide
HTKPQYV

SEQ ID NO: 1192 - protein, 7 aa, Artificial Sequence
  Description of Artificial Sequence: Synthetic peptide
HTKPQHV

SEQ ID NO: 1193 - protein, 7 aa, Artificial Sequence
  Description of Artificial Sequence: Synthetic peptide
HTKPQPV

SEQ ID NO: 1194 - protein, 7 aa, Artificial Sequence
  Description of Artificial Sequence: Synthetic peptide
HTKPQKV

SEQ ID NO: 1195 - protein, 6 aa, Artificial Sequence
  Description of Artificial Sequence: Synthetic peptide
HTKPNV

SEQ ID NO: 1196 - protein, 7 aa, Artificial Sequence
  Description of Artificial Sequence: Synthetic peptide
HTKPNRV

SEQ ID NO: 1197 - protein, 7 aa, Artificial Sequence
  Description of Artificial Sequence: Synthetic peptide
HTKPNFV

SEQ ID NO: 1198 - protein, 7 aa, Artificial Sequence
  Description of Artificial Sequence: Synthetic peptide
HTKPNYV

SEQ ID NO: 1199 - protein, 7 aa, Artificial Sequence
  Description of Artificial Sequence: Synthetic peptide
HTKPNHV

SEQ ID NO: 1200 - protein, 7 aa, Artificial Sequence
  Description of Artificial Sequence: Synthetic peptide
HTKPNPV

SEQ ID NO: 1201 - protein, 7 aa, Artificial Sequence
  Description of Artificial Sequence: Synthetic peptide
HTKPNKV

SEQ ID NO: 1202 - protein, 6 aa, Artificial Sequence
  Description of Artificial Sequence: Synthetic peptide
HTKPYV

SEQ ID NO: 1203 - protein, 7 aa, Artificial Sequence
  Description of Artificial Sequence: Synthetic peptide
HTKPYRV

SEQ ID NO: 1204 - protein, 7 aa, Artificial Sequence
  Description of Artificial Sequence: Synthetic peptide
HTKPYFV

SEQ ID NO: 1205 - protein, 7 aa, Artificial Sequence
  Description of Artificial Sequence: Synthetic peptide
HTKPYYV

SEQ ID NO: 1206 - protein, 7 aa, Artificial Sequence
  Description of Artificial Sequence: Synthetic peptide
HTKPYHV

SEQ ID NO: 1207 - protein, 7 aa, Artificial Sequence
  Description of Artificial Sequence: Synthetic peptide
HTKPYPV

SEQ ID NO: 1208 - protein, 7 aa, Artificial Sequence
  Description of Artificial Sequence: Synthetic peptide
HTKPYKV

SEQ ID NO: 1209 - protein, 6 aa, Artificial Sequence
  Description of Artificial Sequence: Synthetic peptide
HTKPRV

SEQ ID NO: 1210 - protein, 7 aa, Artificial Sequence
  Description of Artificial Sequence: Synthetic peptide
HTKPRRV

SEQ ID NO: 1211 - protein, 7 aa, Artificial Sequence
  Description of Artificial Sequence: Synthetic peptide
HTKPRFV

SEQ ID NO: 1212 - protein, 7 aa, Artificial Sequence
  Description of Artificial Sequence: Synthetic peptide
HTKPRYV

SEQ ID NO: 1213 - protein, 7 aa, Artificial Sequence
  Description of Artificial Sequence: Synthetic peptide
HTKPRHV

SEQ ID NO: 1214 - protein, 7 aa, Artificial Sequence
  Description of Artificial Sequence: Synthetic peptide
HTKPRPV

SEQ ID NO: 1215 - protein, 7 aa, Artificial Sequence
  Description of Artificial Sequence: Synthetic peptide
HTKPRKV

SEQ ID NO: 1216 - protein, 5 aa, Artificial Sequence
  Description of Artificial Sequence: Synthetic peptide
KTKPV

SEQ ID NO: 1217 - protein, 6 aa, Artificial Sequence
  Description of Artificial Sequence: Synthetic peptide
KTKPRV

SEQ ID NO: 1218 - protein, 6 aa, Artificial Sequence
  Description of Artificial Sequence: Synthetic peptide
KTKPFV

SEQ ID NO: 1219 - protein, 6 aa, Artificial Sequence
  Description of Artificial Sequence: Synthetic peptide
KTKPYV

SEQ ID NO: 1220 - protein, 6 aa, Artificial Sequence
  Description of Artificial Sequence: Synthetic peptide
KTKPGV

SEQ ID NO: 1221 - protein, 6 aa, Artificial Sequence
  Description of Artificial Sequence: Synthetic peptide
KTKPHV

SEQ ID NO: 1222 - protein, 6 aa, Artificial Sequence
  Description of Artificial Sequence: Synthetic peptide
KTKPKV

SEQ ID NO: 1223 - protein, 6 aa, Artificial Sequence
  Description of Artificial Sequence: Synthetic peptide
KTKPGV

SEQ ID NO: 1224 - protein, 7 aa, Artificial Sequence
  Description of Artificial Sequence: Synthetic peptide
KTKPGRV

SEQ ID NO: 1225 - protein, 7 aa, Artificial Sequence
  Description of Artificial Sequence: Synthetic peptide
KTKPGFV

SEQ ID NO: 1226 - protein, 7 aa, Artificial Sequence
  Description of Artificial Sequence: Synthetic peptide
KTKPGYV

SEQ ID NO: 1227 - protein, 7 aa, Artificial Sequence
  Description of Artificial Sequence: Synthetic peptide
KTKPGHV

SEQ ID NO: 1228 - protein, 7 aa, Artificial Sequence
  Description of Artificial Sequence: Synthetic peptide
KTKPGPV

SEQ ID NO: 1229 - protein, 7 aa, Artificial Sequence
  Description of Artificial Sequence: Synthetic peptide
KTKPGKV

SEQ ID NO: 1230 - protein, 6 aa, Artificial Sequence
  Description of Artificial Sequence: Synthetic peptide
KTKPDV

SEQ ID NO: 1231 - protein, 7 aa, Artificial Sequence
  Description of Artificial Sequence: Synthetic peptide
KTKPDRV

SEQ ID NO: 1232 - protein, 7 aa, Artificial Sequence
  Description of Artificial Sequence: Synthetic peptide
KTKPDFV

SEQ ID NO: 1233 - protein, 7 aa, Artificial Sequence
  Description of Artificial Sequence: Synthetic peptide
KTKPDYV

SEQ ID NO: 1234 - protein, 7 aa, Artificial Sequence
  Description of Artificial Sequence: Synthetic peptide
KTKPDHV

SEQ ID NO: 1235 - protein, 7 aa, Artificial Sequence
  Description of Artificial Sequence: Synthetic peptide
KTKPDPV

SEQ ID NO: 1236 - protein, 7 aa, Artificial Sequence
  Description of Artificial Sequence: Synthetic peptide
KTKPDKV

SEQ ID NO: 1237 - protein, 6 aa, Artificial Sequence
  Description of Artificial Sequence: Synthetic peptide
KTKPWV

SEQ ID NO: 1238 - protein, 7 aa, Artificial Sequence
  Description of Artificial Sequence: Synthetic peptide
KTKPWRV

SEQ ID NO: 1239 - protein, 7 aa, Artificial Sequence
  Description of Artificial Sequence: Synthetic peptide
KTKPWFV

SEQ ID NO: 1240 - protein, 7 aa, Artificial Sequence
  Description of Artificial Sequence: Synthetic peptide
KTKPWYV

SEQ ID NO: 1241 - protein, 7 aa, Artificial Sequence
  Description of Artificial Sequence: Synthetic peptide
KTKPWHV

SEQ ID NO: 1242 - protein, 7 aa, Artificial Sequence
  Description of Artificial Sequence: Synthetic peptide
KTKPWPV

SEQ ID NO: 1243 - protein, 7 aa, Artificial Sequence
  Description of Artificial Sequence: Synthetic peptide
KTKPWKV

SEQ ID NO: 1244 - protein, 6 aa, Artificial Sequence
  Description of Artificial Sequence: Synthetic peptide
KTKPQV

SEQ ID NO: 1245 - protein, 7 aa, Artificial Sequence
  Description of Artificial Sequence: Synthetic peptide
KTKPQRV

SEQ ID NO: 1246 - protein, 7 aa, Artificial Sequence
  Description of Artificial Sequence: Synthetic peptide
KTKPQFV

SEQ ID NO: 1247 - protein, 7 aa, Artificial Sequence
  Description of Artificial Sequence: Synthetic peptide
KTKPQYV

SEQ ID NO: 1248 - protein, 7 aa, Artificial Sequence
  Description of Artificial Sequence: Synthetic peptide
KTKPQHV

SEQ ID NO: 1249 - protein, 7 aa, Artificial Sequence
  Description of Artificial Sequence: Synthetic peptide
KTKPQPV

SEQ ID NO: 1250 - protein, 7 aa, Artificial Sequence
  Description of Artificial Sequence: Synthetic peptide
KTKPQKV

SEQ ID NO: 1251 - protein, 6 aa, Artificial Sequence
  Description of Artificial Sequence: Synthetic peptide
KTKPNV

SEQ ID NO: 1252 - protein, 7 aa, Artificial Sequence
  Description of Artificial Sequence: Synthetic peptide
KTKPNRV

SEQ ID NO: 1253 - protein, 7 aa, Artificial Sequence
  Description of Artificial Sequence: Synthetic peptide
KTKPNFV

SEQ ID NO: 1254 - protein, 7 aa, Artificial Sequence
  Description of Artificial Sequence: Synthetic peptide
KTKPNYV

SEQ ID NO: 1255 - protein, 7 aa, Artificial Sequence
  Description of Artificial Sequence: Synthetic peptide
KTKPNHV

SEQ ID NO: 1256 - protein, 7 aa, Artificial Sequence
  Description of Artificial Sequence: Synthetic peptide
KTKPNPV

SEQ ID NO: 1257 - protein, 7 aa, Artificial Sequence
  Description of Artificial Sequence: Synthetic peptide
KTKPNKV

SEQ ID NO: 1258 - protein, 6 aa, Artificial Sequence
  Description of Artificial Sequence: Synthetic peptide
KTKPYV

SEQ ID NO: 1259 - protein, 7 aa, Artificial Sequence
  Description of Artificial Sequence: Synthetic peptide
KTKPYRV

SEQ ID NO: 1260 - protein, 7 aa, Artificial Sequence
  Description of Artificial Sequence: Synthetic peptide
KTKPYFV

SEQ ID NO: 1261 - protein, 7 aa, Artificial Sequence
  Description of Artificial Sequence: Synthetic peptide
KTKPYYV

SEQ ID NO: 1262 - protein, 7 aa, Artificial Sequence
  Description of Artificial Sequence: Synthetic peptide
KTKPYHV

SEQ ID NO: 1263 - protein, 7 aa, Artificial Sequence
  Description of Artificial Sequence: Synthetic peptide
KTKPYPV

SEQ ID NO: 1264 - protein, 7 aa, Artificial Sequence
  Description of Artificial Sequence: Synthetic peptide
KTKPYKV

SEQ ID NO: 1265 - protein, 6 aa, Artificial Sequence
  Description of Artificial Sequence: Synthetic peptide
KTKPRV

SEQ ID NO: 1266 - protein, 7 aa, Artificial Sequence
  Description of Artificial Sequence: Synthetic peptide
KTKPRRV

SEQ ID NO: 1267 - protein, 7 aa, Artificial Sequence
  Description of Artificial Sequence: Synthetic peptide
KTKPRFV

SEQ ID NO: 1268 - protein, 7 aa, Artificial Sequence
  Description of Artificial Sequence: Synthetic peptide
KTKPRYV

SEQ ID NO: 1269 - protein, 7 aa, Artificial Sequence
  Description of Artificial Sequence: Synthetic peptide
KTKPRHV

SEQ ID NO: 1270 - protein, 7 aa, Artificial Sequence
  Description of Artificial Sequence: Synthetic peptide
KTKPRPV

SEQ ID NO: 1271 - protein, 7 aa, Artificial Sequence
  Description of Artificial Sequence: Synthetic peptide
KTKPRKV

SEQ ID NO: 1272 - protein, 5 aa, Artificial Sequence
  Description of Artificial Sequence: Synthetic peptide
GTKPV

SEQ ID NO: 1273 - protein, 6 aa, Artificial Sequence
  Description of Artificial Sequence: Synthetic peptide
GTKPRV

SEQ ID NO: 1274 - protein, 6 aa, Artificial Sequence
  Description of Artificial Sequence: Synthetic peptide
GTKPFV

SEQ ID NO: 1275 - protein, 6 aa, Artificial Sequence
  Description of Artificial Sequence: Synthetic peptide
GTKPYV

SEQ ID NO: 1276 - protein, 6 aa, Artificial Sequence
  Description of Artificial Sequence: Synthetic peptide
GTKPGV

SEQ ID NO: 1277 - protein, 6 aa, Artificial Sequence
  Description of Artificial Sequence: Synthetic peptide
GTKPHV

SEQ ID NO: 1278 - protein, 6 aa, Artificial Sequence
  Description of Artificial Sequence: Synthetic peptide
GTKPKV

SEQ ID NO: 1279 - protein, 6 aa, Artificial Sequence
  Description of Artificial Sequence: Synthetic peptide
GTKPGV

SEQ ID NO: 1280 - protein, 7 aa, Artificial Sequence
  Description of Artificial Sequence: Synthetic peptide
GTKPGRV

SEQ ID NO: 1281 - protein, 7 aa, Artificial Sequence
  Description of Artificial Sequence: Synthetic peptide
GTKPGFV

SEQ ID NO: 1282 - protein, 7 aa, Artificial Sequence
  Description of Artificial Sequence: Synthetic peptide
GTKPGYV

SEQ ID NO: 1283 - protein, 7 aa, Artificial Sequence
  Description of Artificial Sequence: Synthetic peptide
GTKPGHV

SEQ ID NO: 1284 - protein, 7 aa, Artificial Sequence
  Description of Artificial Sequence: Synthetic peptide
GTKPGPV

SEQ ID NO: 1285 - protein, 7 aa, Artificial Sequence
  Description of Artificial Sequence: Synthetic peptide
GTKPGKV

SEQ ID NO: 1286 - protein, 6 aa, Artificial Sequence
  Description of Artificial Sequence: Synthetic peptide
GTKPDV

SEQ ID NO: 1287 - protein, 7 aa, Artificial Sequence
  Description of Artificial Sequence: Synthetic peptide
GTKPDRV

SEQ ID NO: 1288 - protein, 7 aa, Artificial Sequence
  Description of Artificial Sequence: Synthetic peptide
GTKPDFV

SEQ ID NO: 1289 - protein, 7 aa, Artificial Sequence
  Description of Artificial Sequence: Synthetic peptide
GTKPDYV

SEQ ID NO: 1290 - protein, 7 aa, Artificial Sequence
  Description of Artificial Sequence: Synthetic peptide
GTKPDHV

SEQ ID NO: 1291 - protein, 7 aa, Artificial Sequence
  Description of Artificial Sequence: Synthetic peptide
GTKPDPV

SEQ ID NO: 1292 - protein, 7 aa, Artificial Sequence
  Description of Artificial Sequence: Synthetic peptide
GTKPDKV

SEQ ID NO: 1293 - protein, 6 aa, Artificial Sequence
  Description of Artificial Sequence: Synthetic peptide
GTKPWV

SEQ ID NO: 1294 - protein, 7 aa, Artificial Sequence
  Description of Artificial Sequence: Synthetic peptide
GTKPWRV

SEQ ID NO: 1295 - protein, 7 aa, Artificial Sequence
  Description of Artificial Sequence: Synthetic peptide
GTKPWFV

SEQ ID NO: 1296 - protein, 7 aa, Artificial Sequence
  Description of Artificial Sequence: Synthetic peptide
GTKPWYV

SEQ ID NO: 1297 - protein, 7 aa, Artificial Sequence
  Description of Artificial Sequence: Synthetic peptide
GTKPWHV

SEQ ID NO: 1298 - protein, 7 aa, Artificial Sequence
  Description of Artificial Sequence: Synthetic peptide
GTKPWPV

SEQ ID NO: 1299 - protein, 7 aa, Artificial Sequence
  Description of Artificial Sequence: Synthetic peptide
GTKPWKV

SEQ ID NO: 1300 - protein, 6 aa, Artificial Sequence
  Description of Artificial Sequence: Synthetic peptide
GTKPQV

SEQ ID NO: 1301 - protein, 7 aa, Artificial Sequence
  Description of Artificial Sequence: Synthetic peptide
GTKPQRV

SEQ ID NO: 1302 - protein, 7 aa, Artificial Sequence
  Description of Artificial Sequence: Synthetic peptide
GTKPQFV

SEQ ID NO: 1303 - protein, 7 aa, Artificial Sequence
  Description of Artificial Sequence: Synthetic peptide
GTKPQYV

SEQ ID NO: 1304 - protein, 7 aa, Artificial Sequence
  Description of Artificial Sequence: Synthetic peptide
GTKPQHV

SEQ ID NO: 1305 - protein, 7 aa, Artificial Sequence
  Description of Artificial Sequence: Synthetic peptide
GTKPQPV

SEQ ID NO: 1306 - protein, 7 aa, Artificial Sequence
  Description of Artificial Sequence: Synthetic peptide
GTKPQKV

SEQ ID NO: 1307 - protein, 6 aa, Artificial Sequence
  Description of Artificial Sequence: Synthetic peptide
GTKPNV

SEQ ID NO: 1308 - protein, 7 aa, Artificial Sequence
  Description of Artificial Sequence: Synthetic peptide
GTKPNRV

SEQ ID NO: 1309 - protein, 7 aa, Artificial Sequence
  Description of Artificial Sequence: Synthetic peptide
GTKPNFV

SEQ ID NO: 1310 - protein, 7 aa, Artificial Sequence
  Description of Artificial Sequence: Synthetic peptide
GTKPNYV

SEQ ID NO: 1311 - protein, 7 aa, Artificial Sequence
  Description of Artificial Sequence: Synthetic peptide
GTKPNHV

SEQ ID NO: 1312 - protein, 7 aa, Artificial Sequence
  Description of Artificial Sequence: Synthetic peptide
GTKPNPV

SEQ ID NO: 1313 - protein, 7 aa, Artificial Sequence
  Description of Artificial Sequence: Synthetic peptide
GTKPNKV

SEQ ID NO: 1314 - protein, 6 aa, Artificial Sequence
  Description of Artificial Sequence: Synthetic peptide
GTKPYV

SEQ ID NO: 1315 - protein, 7 aa, Artificial Sequence
  Description of Artificial Sequence: Synthetic peptide
GTKPYRV

SEQ ID NO: 1316 - protein, 7 aa, Artificial Sequence
  Description of Artificial Sequence: Synthetic peptide
GTKPYFV

SEQ ID NO: 1317 - protein, 7 aa, Artificial Sequence
  Description of Artificial Sequence: Synthetic peptide
GTKPYYV

SEQ ID NO: 1318 - protein, 7 aa, Artificial Sequence
  Description of Artificial Sequence: Synthetic peptide
GTKPYHV

SEQ ID NO: 1319 - protein, 7 aa, Artificial Sequence
  Description of Artificial Sequence: Synthetic peptide
GTKPYPV

SEQ ID NO: 1320 - protein, 7 aa, Artificial Sequence
  Description of Artificial Sequence: Synthetic peptide
GTKPYKV

SEQ ID NO: 1321 - protein, 6 aa, Artificial Sequence
  Description of Artificial Sequence: Synthetic peptide
GTKPRV

SEQ ID NO: 1322 - protein, 7 aa, Artificial Sequence
  Description of Artificial Sequence: Synthetic peptide
GTKPRRV

SEQ ID NO: 1323 - protein, 7 aa, Artificial Sequence
  Description of Artificial Sequence: Synthetic peptide
GTKPRFV

SEQ ID NO: 1324 - protein, 7 aa, Artificial Sequence
  Description of Artificial Sequence: Synthetic peptide
GTKPRYV

SEQ ID NO: 1325 - protein, 7 aa, Artificial Sequence
  Description of Artificial Sequence: Synthetic peptide
GTKPRHV

SEQ ID NO: 1326 - protein, 7 aa, Artificial Sequence
  Description of Artificial Sequence: Synthetic peptide
GTKPRPV

SEQ ID NO: 1327 - protein, 7 aa, Artificial Sequence
  Description of Artificial Sequence: Synthetic peptide
GTKPRKV

SEQ ID NO: 1328 - protein, 5 aa, Artificial Sequence
  Description of Artificial Sequence: Synthetic peptide
MTKPG

SEQ ID NO: 1329 - protein, 5 aa, Artificial Sequence
  Description of Artificial Sequence: Synthetic peptide
MTKPG

SEQ ID NO: 1330 - protein, 5 aa, Artificial Sequence
  Description of Artificial Sequence: Synthetic peptide
TTKPG

SEQ ID NO: 1331 - protein, 5 aa, Artificial Sequence
  Description of Artificial Sequence: Synthetic peptide
ATKPG

SEQ ID NO: 1332 - protein, 5 aa, Artificial Sequence
  Description of Artificial Sequence: Synthetic peptide
HTKPG

SEQ ID NO: 1333 - protein, 5 aa, Artificial Sequence
  Description of Artificial Sequence: Synthetic peptide
KTKPG

SEQ ID NO: 1334 - protein, 5 aa, Artificial Sequence
  Description of Artificial Sequence: Synthetic peptide
GTKPG

SEQ ID NO: 1335 - protein, 5 aa, Artificial Sequence
  Description of Artificial Sequence: Synthetic peptide
TKPRY

SEQ ID NO: 1336 - protein, 5 aa, Artificial Sequence
  Description of Artificial Sequence: Synthetic peptide
TKPFY

SEQ ID NO: 1337 - protein, 5 aa, Artificial Sequence
  Description of Artificial Sequence: Synthetic peptide
TKPYY

SEQ ID NO: 1338 - protein, 5 aa, Artificial Sequence
  Description of Artificial Sequence: Synthetic peptide
TKPGY

SEQ ID NO: 1339 - protein, 5 aa, Artificial Sequence
  Description of Artificial Sequence: Synthetic peptide
TKPHY

SEQ ID NO: 1340 - protein, 5 aa, Artificial Sequence
  Description of Artificial Sequence: Synthetic peptide
TKPKY

SEQ ID NO: 1341 - protein, 5 aa, Artificial Sequence
  Description of Artificial Sequence: Synthetic peptide
TKPGY

SEQ ID NO: 1342 - protein, 6 aa, Artificial Sequence
  Description of Artificial Sequence: Synthetic peptide
TKPGRY

SEQ ID NO: 1343 - protein, 6 aa, Artificial Sequence
  Description of Artificial Sequence: Synthetic peptide
TKPGFY

SEQ ID NO: 1344 - protein, 6 aa, Artificial Sequence
  Description of Artificial Sequence: Synthetic peptide
TKPGYY

SEQ ID NO: 1345 - protein, 6 aa, Artificial Sequence
  Description of Artificial Sequence: Synthetic peptide
TKPGHY

SEQ ID NO: 1346 - protein, 6 aa, Artificial Sequence
  Description of Artificial Sequence: Synthetic peptide
TKPGPY

SEQ ID NO: 1347 - protein, 6 aa, Artificial Sequence
  Description of Artificial Sequence: Synthetic peptide
TKPGKY

SEQ ID NO: 1348 - protein, 5 aa, Artificial Sequence
  Description of Artificial Sequence: Synthetic peptide
TKPDY

SEQ ID NO: 1349 - protein, 6 aa, Artificial Sequence
  Description of Artificial Sequence: Synthetic peptide
TKPDRY

SEQ ID NO: 1350 - protein, 6 aa, Artificial Sequence
  Description of Artificial Sequence: Synthetic peptide
TKPDFY

SEQ ID NO: 1351 - protein, 6 aa, Artificial Sequence
  Description of Artificial Sequence: Synthetic peptide
TKPDYY

SEQ ID NO: 1352 - protein, 6 aa, Artificial Sequence
  Description of Artificial Sequence: Synthetic peptide
TKPDHY

SEQ ID NO: 1353 - protein, 6 aa, Artificial Sequence
  Description of Artificial Sequence: Synthetic peptide
TKPDPY

SEQ ID NO: 1354 - protein, 6 aa, Artificial Sequence
  Description of Artificial Sequence: Synthetic peptide
TKPDKY

SEQ ID NO: 1355 - protein, 5 aa, Artificial Sequence
  Description of Artificial Sequence: Synthetic peptide
TKPWY

SEQ ID NO: 1356 - protein, 6 aa, Artificial Sequence
  Description of Artificial Sequence: Synthetic peptide
TKPWRY

SEQ ID NO: 1357 - protein, 6 aa, Artificial Sequence
  Description of Artificial Sequence: Synthetic peptide
TKPWFY

SEQ ID NO: 1358 - protein, 6 aa, Artificial Sequence
  Description of Artificial Sequence: Synthetic peptide
TKPWYY

SEQ ID NO: 1359 - protein, 6 aa, Artificial Sequence
  Description of Artificial Sequence: Synthetic peptide
TKPWHY

SEQ ID NO: 1360 - protein, 6 aa, Artificial Sequence
  Description of Artificial Sequence: Synthetic peptide
TKPWPY

SEQ ID NO: 1361 - protein, 6 aa, Artificial Sequence
  Description of Artificial Sequence: Synthetic peptide
TKPWKY

SEQ ID NO: 1362 - protein, 5 aa, Artificial Sequence
  Description of Artificial Sequence: Synthetic peptide
TKPQY

SEQ ID NO: 1363 - protein, 6 aa, Artificial Sequence
  Description of Artificial Sequence: Synthetic peptide
TKPQRY

SEQ ID NO: 1364 - protein, 6 aa, Artificial Sequence
  Description of Artificial Sequence: Synthetic peptide
TKPQFY

SEQ ID NO: 1365 - protein, 6 aa, Artificial Sequence
  Description of Artificial Sequence: Synthetic peptide
TKPQYY

SEQ ID NO: 1366 - protein, 6 aa, Artificial Sequence
  Description of Artificial Sequence: Synthetic peptide
TKPQHY

SEQ ID NO: 1367 - protein, 6 aa, Artificial Sequence
  Description of Artificial Sequence: Synthetic peptide
TKPQPY

SEQ ID NO: 1368 - protein, 6 aa, Artificial Sequence
  Description of Artificial Sequence: Synthetic peptide
TKPQKY

SEQ ID NO: 1369 - protein, 5 aa, Artificial Sequence
  Description of Artificial Sequence: Synthetic peptide
TKPNY

SEQ ID NO: 1370 - protein, 6 aa, Artificial Sequence
  Description of Artificial Sequence: Synthetic peptide
TKPNRY

SEQ ID NO: 1371 - protein, 6 aa, Artificial Sequence
  Description of Artificial Sequence: Synthetic peptide
TKPNFY

SEQ ID NO: 1372 - protein, 6 aa, Artificial Sequence
  Description of Artificial Sequence: Synthetic peptide
TKPNYY

SEQ ID NO: 1373 - protein, 6 aa, Artificial Sequence
  Description of Artificial Sequence: Synthetic peptide
TKPNHY

SEQ ID NO: 1374 - protein, 6 aa, Artificial Sequence
  Description of Artificial Sequence: Synthetic peptide
TKPNPY

SEQ ID NO: 1375 - protein, 6 aa, Artificial Sequence
  Description of Artificial Sequence: Synthetic peptide
TKPNKY

SEQ ID NO: 1376 - protein, 5 aa, Artificial Sequence
  Description of Artificial Sequence: Synthetic peptide
TKPYY

SEQ ID NO: 1377 - protein, 6 aa, Artificial Sequence
  Description of Artificial Sequence: Synthetic peptide
TKPYRY

SEQ ID NO: 1378 - protein, 6 aa, Artificial Sequence
  Description of Artificial Sequence: Synthetic peptide
TKPYFY

SEQ ID NO: 1379 - protein, 6 aa, Artificial Sequence
  Description of Artificial Sequence: Synthetic peptide
TKPYYY

SEQ ID NO: 1380 - protein, 6 aa, Artificial Sequence
  Description of Artificial Sequence: Synthetic peptide
TKPYHY

SEQ ID NO: 1381 - protein, 6 aa, Artificial Sequence
  Description of Artificial Sequence: Synthetic peptide
TKPYPY

SEQ ID NO: 1382 - protein, 6 aa, Artificial Sequence
  Description of Artificial Sequence: Synthetic peptide
TKPYKY

SEQ ID NO: 1383 - protein, 5 aa, Artificial Sequence
  Description of Artificial Sequence: Synthetic peptide
TKPRY

SEQ ID NO: 1384 - protein, 6 aa, Artificial Sequence
  Description of Artificial Sequence: Synthetic peptide
TKPRRY

SEQ ID NO: 1385 - protein, 6 aa, Artificial Sequence
  Description of Artificial Sequence: Synthetic peptide
TKPRFY

SEQ ID NO: 1386 - protein, 6 aa, Artificial Sequence
  Description of Artificial Sequence: Synthetic peptide
TKPRYY

SEQ ID NO: 1387 - protein, 6 aa, Artificial Sequence
  Description of Artificial Sequence: Synthetic peptide
TKPRHY

SEQ ID NO: 1388 - protein, 6 aa, Artificial Sequence
  Description of Artificial Sequence: Synthetic peptide
TKPRPY

SEQ ID NO: 1389 - protein, 6 aa, Artificial Sequence
  Description of Artificial Sequence: Synthetic peptide
TKPRKY

SEQ ID NO: 1390 - protein, 5 aa, Artificial Sequence
  Description of Artificial Sequence: Synthetic peptide
MTKPY

SEQ ID NO: 1391 - protein, 6 aa, Artificial Sequence
  Description of Artificial Sequence: Synthetic peptide
MTKPRY

SEQ ID NO: 1392 - protein, 6 aa, Artificial Sequence
  Description of Artificial Sequence: Synthetic peptide
MTKPFY

SEQ ID NO: 1393 - protein, 6 aa, Artificial Sequence
  Description of Artificial Sequence: Synthetic peptide
MTKPYY

SEQ ID NO: 1394 - protein, 6 aa, Artificial Sequence
  Description of Artificial Sequence: Synthetic peptide
MTKPGY

SEQ ID NO: 1395 - protein, 6 aa, Artificial Sequence
  Description of Artificial Sequence: Synthetic peptide
MTKPHY

SEQ ID NO: 1396 - protein, 6 aa, Artificial Sequence
  Description of Artificial Sequence: Synthetic peptide
MTKPKY

SEQ ID NO: 1397 - protein, 6 aa, Artificial Sequence
  Description of Artificial Sequence: Synthetic peptide
MTKPGY

SEQ ID NO: 1398 - protein, 7 aa, Artificial Sequence
  Description of Artificial Sequence: Synthetic peptide
MTKPGRY

SEQ ID NO: 1399 - protein, 7 aa, Artificial Sequence
  Description of Artificial Sequence: Synthetic peptide
MTKPGFY

SEQ ID NO: 1400 - protein, 7 aa, Artificial Sequence
  Description of Artificial Sequence: Synthetic peptide
MTKPGYY

SEQ ID NO: 1401 - protein, 7 aa, Artificial Sequence
  Description of Artificial Sequence: Synthetic peptide
MTKPGHY

SEQ ID NO: 1402 - protein, 7 aa, Artificial Sequence
  Description of Artificial Sequence: Synthetic peptide
MTKPGPY

SEQ ID NO: 1403 - protein, 7 aa, Artificial Sequence
  Description of Artificial Sequence: Synthetic peptide
MTKPGKY

SEQ ID NO: 1404 - protein, 6 aa, Artificial Sequence
  Description of Artificial Sequence: Synthetic peptide
MTKPDY

SEQ ID NO: 1405 - protein, 7 aa, Artificial Sequence
  Description of Artificial Sequence: Synthetic peptide
MTKPDRY

SEQ ID NO: 1406 - protein, 7 aa, Artificial Sequence
  Description of Artificial Sequence: Synthetic peptide
MTKPDFY

SEQ ID NO: 1407 - protein, 7 aa, Artificial Sequence
  Description of Artificial Sequence: Synthetic peptide
MTKPDYY

SEQ ID NO: 1408 - protein, 7 aa, Artificial Sequence
  Description of Artificial Sequence: Synthetic peptide
MTKPDHY

SEQ ID NO: 1409 - protein, 7 aa, Artificial Sequence
  Description of Artificial Sequence: Synthetic peptide
MTKPDPY

SEQ ID NO: 1410 - protein, 7 aa, Artificial Sequence
  Description of Artificial Sequence: Synthetic peptide
MTKPDKY

SEQ ID NO: 1411 - protein, 6 aa, Artificial Sequence
  Description of Artificial Sequence: Synthetic peptide
MTKPWY

SEQ ID NO: 1412 - protein, 7 aa, Artificial Sequence
  Description of Artificial Sequence: Synthetic peptide
MTKPWRY

SEQ ID NO: 1413 - protein, 7 aa, Artificial Sequence
  Description of Artificial Sequence: Synthetic peptide
MTKPWFY

SEQ ID NO: 1414 - protein, 7 aa, Artificial Sequence
  Description of Artificial Sequence: Synthetic peptide
MTKPWYY

SEQ ID NO: 1415 - protein, 7 aa, Artificial Sequence
  Description of Artificial Sequence: Synthetic peptide
MTKPWHY

SEQ ID NO: 1416 - protein, 7 aa, Artificial Sequence
  Description of Artificial Sequence: Synthetic peptide
MTKPWPY

SEQ ID NO: 1417 - protein, 7 aa, Artificial Sequence
  Description of Artificial Sequence: Synthetic peptide
MTKPWKY

SEQ ID NO: 1418 - protein, 6 aa, Artificial Sequence
  Description of Artificial Sequence: Synthetic peptide
MTKPQY

SEQ ID NO: 1419 - protein, 7 aa, Artificial Sequence
  Description of Artificial Sequence: Synthetic peptide
MTKPQRY

SEQ ID NO: 1420 - protein, 7 aa, Artificial Sequence
  Description of Artificial Sequence: Synthetic peptide
MTKPQFY

SEQ ID NO: 1421 - protein, 7 aa, Artificial Sequence
  Description of Artificial Sequence: Synthetic peptide
MTKPQYY

SEQ ID NO: 1422 - protein, 7 aa, Artificial Sequence
  Description of Artificial Sequence: Synthetic peptide
MTKPQHY

SEQ ID NO: 1423 - protein, 7 aa, Artificial Sequence
  Description of Artificial Sequence: Synthetic peptide
MTKPQPY

SEQ ID NO: 1424 - protein, 7 aa, Artificial Sequence
  Description of Artificial Sequence: Synthetic peptide
MTKPQKY

SEQ ID NO: 1425 - protein, 6 aa, Artificial Sequence
  Description of Artificial Sequence: Synthetic peptide
MTKPNY

SEQ ID NO: 1426 - protein, 7 aa, Artificial Sequence
  Description of Artificial Sequence: Synthetic peptide
MTKPNRY

SEQ ID NO: 1427 - protein, 7 aa, Artificial Sequence
  Description of Artificial Sequence: Synthetic peptide
MTKPNFY

SEQ ID NO: 1428 - protein, 7 aa, Artificial Sequence
  Description of Artificial Sequence: Synthetic peptide
MTKPNYY

SEQ ID NO: 1429 - protein, 7 aa, Artificial Sequence
  Description of Artificial Sequence: Synthetic peptide
MTKPNHY

SEQ ID NO: 1430 - protein, 7 aa, Artificial Sequence
  Description of Artificial Sequence: Synthetic peptide
MTKPNPY

SEQ ID NO: 1431 - protein, 7 aa, Artificial Sequence
  Description of Artificial Sequence: Synthetic peptide
MTKPNKY

SEQ ID NO: 1432 - protein, 6 aa, Artificial Sequence
  Description of Artificial Sequence: Synthetic peptide
MTKPYY

SEQ ID NO: 1433 - protein, 7 aa, Artificial Sequence
  Description of Artificial Sequence: Synthetic peptide
MTKPYRY

SEQ ID NO: 1434 - protein, 7 aa, Artificial Sequence
  Description of Artificial Sequence: Synthetic peptide
MTKPYFY

SEQ ID NO: 1435 - protein, 7 aa, Artificial Sequence
  Description of Artificial Sequence: Synthetic peptide
MTKPYYY

SEQ ID NO: 1436 - protein, 7 aa, Artificial Sequence
  Description of Artificial Sequence: Synthetic peptide
MTKPYHY

SEQ ID NO: 1437 - protein, 7 aa, Artificial Sequence
  Description of Artificial Sequence: Synthetic peptide
MTKPYPY

SEQ ID NO: 1438 - protein, 7 aa, Artificial Sequence
  Description of Artificial Sequence: Synthetic peptide
MTKPYKY

SEQ ID NO: 1439 - protein, 6 aa, Artificial Sequence
  Description of Artificial Sequence: Synthetic peptide
MTKPRY

SEQ ID NO: 1440 - protein, 7 aa, Artificial Sequence
  Description of Artificial Sequence: Synthetic peptide
MTKPRRY

SEQ ID NO: 1441 - protein, 7 aa, Artificial Sequence
  Description of Artificial Sequence: Synthetic peptide
MTKPRFY

SEQ ID NO: 1442 - protein, 7 aa, Artificial Sequence
  Description of Artificial Sequence: Synthetic peptide
MTKPRYY

SEQ ID NO: 1443 - protein, 7 aa, Artificial Sequence
  Description of Artificial Sequence: Synthetic peptide
MTKPRHY

SEQ ID NO: 1444 - protein, 7 aa, Artificial Sequence
  Description of Artificial Sequence: Synthetic peptide
MTKPRPY

SEQ ID NO: 1445 - protein, 7 aa, Artificial Sequence
  Description of Artificial Sequence: Synthetic peptide
MTKPRKY

SEQ ID NO: 1446 - protein, 5 aa, Artificial Sequence
  Description of Artificial Sequence: Synthetic peptide
MTKPY

SEQ ID NO: 1447 - protein, 6 aa, Artificial Sequence
  Description of Artificial Sequence: Synthetic peptide
MTKPRY

SEQ ID NO: 1448 - protein, 6 aa, Artificial Sequence
  Description of Artificial Sequence: Synthetic peptide
MTKPFY

SEQ ID NO: 1449 - protein, 6 aa, Artificial Sequence
  Description of Artificial Sequence: Synthetic peptide
MTKPYY

SEQ ID NO: 1450 - protein, 6 aa, Artificial Sequence
  Description of Artificial Sequence: Synthetic peptide
MTKPGY

SEQ ID NO: 1451 - protein, 6 aa, Artificial Sequence
  Description of Artificial Sequence: Synthetic peptide
MTKPHY

SEQ ID NO: 1452 - protein, 6 aa, Artificial Sequence
  Description of Artificial Sequence: Synthetic peptide
MTKPKY

SEQ ID NO: 1453 - protein, 6 aa, Artificial Sequence
  Description of Artificial Sequence: Synthetic peptide
MTKPGY

SEQ ID NO: 1454 - protein, 7 aa, Artificial Sequence
  Description of Artificial Sequence: Synthetic peptide
MTKPGRY

SEQ ID NO: 1455 - protein, 7 aa, Artificial Sequence
  Description of Artificial Sequence: Synthetic peptide
MTKPGFY

SEQ ID NO: 1456 - protein, 7 aa, Artificial Sequence
  Description of Artificial Sequence: Synthetic peptide
MTKPGYY

SEQ ID NO: 1457 - protein, 7 aa, Artificial Sequence
  Description of Artificial Sequence: Synthetic peptide
MTKPGHY

SEQ ID NO: 1458 - protein, 7 aa, Artificial Sequence
  Description of Artificial Sequence: Synthetic peptide
MTKPGPY

SEQ ID NO: 1459 - protein, 7 aa, Artificial Sequence
  Description of Artificial Sequence: Synthetic peptide
MTKPGKY

SEQ ID NO: 1460 - protein, 6 aa, Artificial Sequence
  Description of Artificial Sequence: Synthetic peptide
MTKPDY

SEQ ID NO: 1461 - protein, 7 aa, Artificial Sequence
  Description of Artificial Sequence: Synthetic peptide
MTKPDRY

SEQ ID NO: 1462 - protein, 7 aa, Artificial Sequence
  Description of Artificial Sequence: Synthetic peptide
MTKPDFY

SEQ ID NO: 1463 - protein, 7 aa, Artificial Sequence
  Description of Artificial Sequence: Synthetic peptide
MTKPDYY

SEQ ID NO: 1464 - protein, 7 aa, Artificial Sequence
  Description of Artificial Sequence: Synthetic peptide
MTKPDHY

SEQ ID NO: 1465 - protein, 7 aa, Artificial Sequence
  Description of Artificial Sequence: Synthetic peptide
MTKPDPY

SEQ ID NO: 1466 - protein, 7 aa, Artificial Sequence
  Description of Artificial Sequence: Synthetic peptide
MTKPDKY

SEQ ID NO: 1467 - protein, 6 aa, Artificial Sequence
  Description of Artificial Sequence: Synthetic peptide
MTKPWY

SEQ ID NO: 1468 - protein, 7 aa, Artificial Sequence
  Description of Artificial Sequence: Synthetic peptide
MTKPWRY

SEQ ID NO: 1469 - protein, 7 aa, Artificial Sequence
  Description of Artificial Sequence: Synthetic peptide
MTKPWFY

SEQ ID NO: 1470 - protein, 7 aa, Artificial Sequence
  Description of Artificial Sequence: Synthetic peptide
MTKPWYY

SEQ ID NO: 1471 - protein, 7 aa, Artificial Sequence
  Description of Artificial Sequence: Synthetic peptide
MTKPWHY

SEQ ID NO: 1472 - protein, 7 aa, Artificial Sequence
  Description of Artificial Sequence: Synthetic peptide
MTKPWPY

SEQ ID NO: 1473 - protein, 7 aa, Artificial Sequence
  Description of Artificial Sequence: Synthetic peptide
MTKPWKY

SEQ ID NO: 1474 - protein, 6 aa, Artificial Sequence
  Description of Artificial Sequence: Synthetic peptide
MTKPQY

SEQ ID NO: 1475 - protein, 7 aa, Artificial Sequence
  Description of Artificial Sequence: Synthetic peptide
MTKPQRY

SEQ ID NO: 1476 - protein, 7 aa, Artificial Sequence
  Description of Artificial Sequence: Synthetic peptide
MTKPQFY

SEQ ID NO: 1477 - protein, 7 aa, Artificial Sequence
  Description of Artificial Sequence: Synthetic peptide
MTKPQYY

SEQ ID NO: 1478 - protein, 7 aa, Artificial Sequence
  Description of Artificial Sequence: Synthetic peptide
MTKPQHY

SEQ ID NO: 1479 - protein, 7 aa, Artificial Sequence
  Description of Artificial Sequence: Synthetic peptide
MTKPQPY

SEQ ID NO: 1480 - protein, 7 aa, Artificial Sequence
  Description of Artificial Sequence: Synthetic peptide
MTKPQKY

SEQ ID NO: 1481 - protein, 6 aa, Artificial Sequence
  Description of Artificial Sequence: Synthetic peptide
MTKPNY

SEQ ID NO: 1482 - protein, 7 aa, Artificial Sequence
  Description of Artificial Sequence: Synthetic peptide
MTKPNRY

SEQ ID NO: 1483 - protein, 7 aa, Artificial Sequence
  Description of Artificial Sequence: Synthetic peptide
MTKPNFY

SEQ ID NO: 1484 - protein, 7 aa, Artificial Sequence
  Description of Artificial Sequence: Synthetic peptide
MTKPNYY

SEQ ID NO: 1485 - protein, 7 aa, Artificial Sequence
  Description of Artificial Sequence: Synthetic peptide
MTKPNHY

SEQ ID NO: 1486 - protein, 7 aa, Artificial Sequence
  Description of Artificial Sequence: Synthetic peptide
MTKPNPY

SEQ ID NO: 1487 - protein, 7 aa, Artificial Sequence
  Description of Artificial Sequence: Synthetic peptide
MTKPNKY

SEQ ID NO: 1488 - protein, 6 aa, Artificial Sequence
  Description of Artificial Sequence: Synthetic peptide
MTKPYY

SEQ ID NO: 1489 - protein, 7 aa, Artificial Sequence
  Description of Artificial Sequence: Synthetic peptide
MTKPYRY

SEQ ID NO: 1490 - protein, 7 aa, Artificial Sequence
  Description of Artificial Sequence: Synthetic peptide
MTKPYFY

SEQ ID NO: 1491 - protein, 7 aa, Artificial Sequence
  Description of Artificial Sequence: Synthetic peptide
MTKPYYY

SEQ ID NO: 1492 - protein, 7 aa, Artificial Sequence
  Description of Artificial Sequence: Synthetic peptide
MTKPYHY

SEQ ID NO: 1493 - protein, 7 aa, Artificial Sequence
  Description of Artificial Sequence: Synthetic peptide
MTKPYPY

SEQ ID NO: 1494 - protein, 7 aa, Artificial Sequence
  Description of Artificial Sequence: Synthetic peptide
MTKPYKY

SEQ ID NO: 1495 - protein, 6 aa, Artificial Sequence
  Description of Artificial Sequence: Synthetic peptide
MTKPRY

SEQ ID NO: 1496 - protein, 7 aa, Artificial Sequence
  Description of Artificial Sequence: Synthetic peptide
MTKPRRY

SEQ ID NO: 1497 - protein, 7 aa, Artificial Sequence
  Description of Artificial Sequence: Synthetic peptide
MTKPRFY

SEQ ID NO: 1498 - protein, 7 aa, Artificial Sequence
  Description of Artificial Sequence: Synthetic peptide
MTKPRYY

SEQ ID NO: 1499 - protein, 7 aa, Artificial Sequence
  Description of Artificial Sequence: Synthetic peptide
MTKPRHY

SEQ ID NO: 1500 - protein, 7 aa, Artificial Sequence
  Description of Artificial Sequence: Synthetic peptide
MTKPRPY

SEQ ID NO: 1501 - protein, 7 aa, Artificial Sequence
  Description of Artificial Sequence: Synthetic peptide
MTKPRKY

SEQ ID NO: 1502 - protein, 5 aa, Artificial Sequence
  Description of Artificial Sequence: Synthetic peptide
TTKPY

SEQ ID NO: 1503 - protein, 6 aa, Artificial Sequence
  Description of Artificial Sequence: Synthetic peptide
TTKPRY

SEQ ID NO: 1504 - protein, 6 aa, Artificial Sequence
  Description of Artificial Sequence: Synthetic peptide
TTKPFY

SEQ ID NO: 1505 - protein, 6 aa, Artificial Sequence
  Description of Artificial Sequence: Synthetic peptide
TTKPYY

SEQ ID NO: 1506 - protein, 6 aa, Artificial Sequence
  Description of Artificial Sequence: Synthetic peptide
TTKPGY

SEQ ID NO: 1507 - protein, 6 aa, Artificial Sequence
  Description of Artificial Sequence: Synthetic peptide
TTKPHY

SEQ ID NO: 1508 - protein, 6 aa, Artificial Sequence
  Description of Artificial Sequence: Synthetic peptide
TTKPKY

SEQ ID NO: 1509 - protein, 6 aa, Artificial Sequence
  Description of Artificial Sequence: Synthetic peptide
TTKPGY

SEQ ID NO: 1510 - protein, 7 aa, Artificial Sequence
  Description of Artificial Sequence: Synthetic peptide
TTKPGRY

SEQ ID NO: 1511 - protein, 7 aa, Artificial Sequence
  Description of Artificial Sequence: Synthetic peptide
TTKPGFY

SEQ ID NO: 1512 - protein, 7 aa, Artificial Sequence
  Description of Artificial Sequence: Synthetic peptide
TTKPGYY

SEQ ID NO: 1513 - protein, 7 aa, Artificial Sequence
  Description of Artificial Sequence: Synthetic peptide
TTKPGHY

SEQ ID NO: 1514 - protein, 7 aa, Artificial Sequence
  Description of Artificial Sequence: Synthetic peptide
TTKPGPY

SEQ ID NO: 1515 - protein, 7 aa, Artificial Sequence
  Description of Artificial Sequence: Synthetic peptide
TTKPGKY

SEQ ID NO: 1516 - protein, 6 aa, Artificial Sequence
  Description of Artificial Sequence: Synthetic peptide
TTKPDY

SEQ ID NO: 1517 - protein, 7 aa, Artificial Sequence
  Description of Artificial Sequence: Synthetic peptide
TTKPDRY

SEQ ID NO: 1518 - protein, 7 aa, Artificial Sequence
  Description of Artificial Sequence: Synthetic peptide
TTKPDFY

SEQ ID NO: 1519 - protein, 7 aa, Artificial Sequence
  Description of Artificial Sequence: Synthetic peptide
TTKPDYY

SEQ ID NO: 1520 - protein, 7 aa, Artificial Sequence
  Description of Artificial Sequence: Synthetic peptide
TTKPDHY

SEQ ID NO: 1521 - protein, 7 aa, Artificial Sequence
  Description of Artificial Sequence: Synthetic peptide
TTKPDPY

SEQ ID NO: 1522 - protein, 7 aa, Artificial Sequence
  Description of Artificial Sequence: Synthetic peptide
TTKPDKY

SEQ ID NO: 1523 - protein, 6 aa, Artificial Sequence
  Description of Artificial Sequence: Synthetic peptide
TTKPWY

SEQ ID NO: 1524 - protein, 7 aa, Artificial Sequence
  Description of Artificial Sequence: Synthetic peptide
TTKPWRY

SEQ ID NO: 1525 - protein, 7 aa, Artificial Sequence
  Description of Artificial Sequence: Synthetic peptide
TTKPWFY

SEQ ID NO: 1526 - protein, 7 aa, Artificial Sequence
  Description of Artificial Sequence: Synthetic peptide
TTKPWYY

SEQ ID NO: 1527 - protein, 7 aa, Artificial Sequence
  Description of Artificial Sequence: Synthetic peptide
TTKPWHY

SEQ ID NO: 1528 - protein, 7 aa, Artificial Sequence
  Description of Artificial Sequence: Synthetic peptide
TTKPWPY

SEQ ID NO: 1529 - protein, 7 aa, Artificial Sequence
  Description of Artificial Sequence: Synthetic peptide
TTKPWKY

SEQ ID NO: 1530 - protein, 6 aa, Artificial Sequence
  Description of Artificial Sequence: Synthetic peptide
TTKPQY

SEQ ID NO: 1531 - protein, 7 aa, Artificial Sequence
  Description of Artificial Sequence: Synthetic peptide
TTKPQRY

SEQ ID NO: 1532 - protein, 7 aa, Artificial Sequence
  Description of Artificial Sequence: Synthetic peptide
TTKPQFY

SEQ ID NO: 1533 - protein, 7 aa, Artificial Sequence
  Description of Artificial Sequence: Synthetic peptide
TTKPQYY

SEQ ID NO: 1534 - protein, 7 aa, Artificial Sequence
  Description of Artificial Sequence: Synthetic peptide
TTKPQHY

SEQ ID NO: 1535 - protein, 7 aa, Artificial Sequence
  Description of Artificial Sequence: Synthetic peptide
TTKPQPY

SEQ ID NO: 1536 - protein, 7 aa, Artificial Sequence
  Description of Artificial Sequence: Synthetic peptide
TTKPQKY

SEQ ID NO: 1537 - protein, 6 aa, Artificial Sequence
  Description of Artificial Sequence: Synthetic peptide
TTKPNY

SEQ ID NO: 1538 - protein, 7 aa, Artificial Sequence
  Description of Artificial Sequence: Synthetic peptide
TTKPNRY

SEQ ID NO: 1539 - protein, 7 aa, Artificial Sequence
  Description of Artificial Sequence: Synthetic peptide
TTKPNFY

SEQ ID NO: 1540 - protein, 7 aa, Artificial Sequence
  Description of Artificial Sequence: Synthetic peptide
TTKPNYY

SEQ ID NO: 1541 - protein, 7 aa, Artificial Sequence
  Description of Artificial Sequence: Synthetic peptide
TTKPNHY

SEQ ID NO: 1542 - protein, 7 aa, Artificial Sequence
  Description of Artificial Sequence: Synthetic peptide
TTKPNPY

SEQ ID NO: 1543 - protein, 7 aa, Artificial Sequence
  Description of Artificial Sequence: Synthetic peptide
TTKPNKY

SEQ ID NO: 1544 - protein, 6 aa, Artificial Sequence
  Description of Artificial Sequence: Synthetic peptide
TTKPYY

SEQ ID NO: 1545 - protein, 7 aa, Artificial Sequence
  Description of Artificial Sequence: Synthetic peptide
TTKPYRY

SEQ ID NO: 1546 - protein, 7 aa, Artificial Sequence
  Description of Artificial Sequence: Synthetic peptide
TTKPYFY

SEQ ID NO: 1547 - protein, 7 aa, Artificial Sequence
  Description of Artificial Sequence: Synthetic peptide
TTKPYYY

SEQ ID NO: 1548 - protein, 7 aa, Artificial Sequence
  Description of Artificial Sequence: Synthetic peptide
TTKPYHY

SEQ ID NO: 1549 - protein, 7 aa, Artificial Sequence
  Description of Artificial Sequence: Synthetic peptide
TTKPYPY

SEQ ID NO: 1550 - protein, 7 aa, Artificial Sequence
  Description of Artificial Sequence: Synthetic peptide
TTKPYKY

SEQ ID NO: 1551 - protein, 6 aa, Artificial Sequence
  Description of Artificial Sequence: Synthetic peptide
TTKPRY

SEQ ID NO: 1552 - protein, 7 aa, Artificial Sequence
  Description of Artificial Sequence: Synthetic peptide
TTKPRRY

SEQ ID NO: 1553 - protein, 7 aa, Artificial Sequence
  Description of Artificial Sequence: Synthetic peptide
TTKPRFY

SEQ ID NO: 1554 - protein, 7 aa, Artificial Sequence
  Description of Artificial Sequence: Synthetic peptide
TTKPRYY

SEQ ID NO: 1555 - protein, 7 aa, Artificial Sequence
  Description of Artificial Sequence: Synthetic peptide
TTKPRHY

SEQ ID NO: 1556 - protein, 7 aa, Artificial Sequence
  Description of Artificial Sequence: Synthetic peptide
TTKPRPY

SEQ ID NO: 1557 - protein, 7 aa, Artificial Sequence
  Description of Artificial Sequence: Synthetic peptide
TTKPRKY

SEQ ID NO: 1558 - protein, 5 aa, Artificial Sequence
  Description of Artificial Sequence: Synthetic peptide
ATKPY

SEQ ID NO: 1559 - protein, 6 aa, Artificial Sequence
  Description of Artificial Sequence: Synthetic peptide
ATKPRY

SEQ ID NO: 1560 - protein, 6 aa, Artificial Sequence
  Description of Artificial Sequence: Synthetic peptide
ATKPFY

SEQ ID NO: 1561 - protein, 6 aa, Artificial Sequence
  Description of Artificial Sequence: Synthetic peptide
ATKPYY

SEQ ID NO: 1562 - protein, 6 aa, Artificial Sequence
  Description of Artificial Sequence: Synthetic peptide
ATKPGY

SEQ ID NO: 1563 - protein, 6 aa, Artificial Sequence
  Description of Artificial Sequence: Synthetic peptide
ATKPHY

SEQ ID NO: 1564 - protein, 6 aa, Artificial Sequence
  Description of Artificial Sequence: Synthetic peptide
ATKPKY

SEQ ID NO: 1565 - protein, 6 aa, Artificial Sequence
  Description of Artificial Sequence: Synthetic peptide
ATKPGY

SEQ ID NO: 1566 - protein, 7 aa, Artificial Sequence
  Description of Artificial Sequence: Synthetic peptide
ATKPGRY

SEQ ID NO: 1567 - protein, 7 aa, Artificial Sequence
  Description of Artificial Sequence: Synthetic peptide
ATKPGFY

SEQ ID NO: 1568 - protein, 7 aa, Artificial Sequence
  Description of Artificial Sequence: Synthetic peptide
ATKPGYY

SEQ ID NO: 1569 - protein, 7 aa, Artificial Sequence
  Description of Artificial Sequence: Synthetic peptide
ATKPGHY

SEQ ID NO: 1570 - protein, 7 aa, Artificial Sequence
  Description of Artificial Sequence: Synthetic peptide
ATKPGPY

SEQ ID NO: 1571 - protein, 7 aa, Artificial Sequence
  Description of Artificial Sequence: Synthetic peptide
ATKPGKY

SEQ ID NO: 1572 - protein, 6 aa, Artificial Sequence
  Description of Artificial Sequence: Synthetic peptide
ATKPDY

SEQ ID NO: 1573 - protein, 7 aa, Artificial Sequence
  Description of Artificial Sequence: Synthetic peptide
ATKPDRY

SEQ ID NO: 1574 - protein, 7 aa, Artificial Sequence
  Description of Artificial Sequence: Synthetic peptide
ATKPDFY

SEQ ID NO: 1575 - protein, 7 aa, Artificial Sequence
  Description of Artificial Sequence: Synthetic peptide
ATKPDYY

SEQ ID NO: 1576 - protein, 7 aa, Artificial Sequence
  Description of Artificial Sequence: Synthetic peptide
ATKPDHY

SEQ ID NO: 1577 - protein, 7 aa, Artificial Sequence
  Description of Artificial Sequence: Synthetic peptide
ATKPDPY

SEQ ID NO: 1578 - protein, 7 aa, Artificial Sequence
  Description of Artificial Sequence: Synthetic peptide
ATKPDKY

SEQ ID NO: 1579 - protein, 6 aa, Artificial Sequence
  Description of Artificial Sequence: Synthetic peptide
ATKPWY

SEQ ID NO: 1580 - protein, 7 aa, Artificial Sequence
  Description of Artificial Sequence: Synthetic peptide
ATKPWRY

SEQ ID NO: 1581 - protein, 7 aa, Artificial Sequence
  Description of Artificial Sequence: Synthetic peptide
ATKPWFY

SEQ ID NO: 1582 - protein, 7 aa, Artificial Sequence
  Description of Artificial Sequence: Synthetic peptide
ATKPWYY

SEQ ID NO: 1583 - protein, 7 aa, Artificial Sequence
  Description of Artificial Sequence: Synthetic peptide
ATKPWHY

SEQ ID NO: 1584 - protein, 7 aa, Artificial Sequence
  Description of Artificial Sequence: Synthetic peptide
ATKPWPY

SEQ ID NO: 1585 - protein, 7 aa, Artificial Sequence
  Description of Artificial Sequence: Synthetic peptide
ATKPWKY

SEQ ID NO: 1586 - protein, 6 aa, Artificial Sequence
  Description of Artificial Sequence: Synthetic peptide
ATKPQY

SEQ ID NO: 1587 - protein, 7 aa, Artificial Sequence
  Description of Artificial Sequence: Synthetic peptide
ATKPQRY

SEQ ID NO: 1588 - protein, 7 aa, Artificial Sequence
  Description of Artificial Sequence: Synthetic peptide
ATKPQFY

SEQ ID NO: 1589 - protein, 7 aa, Artificial Sequence
  Description of Artificial Sequence: Synthetic peptide
ATKPQYY

SEQ ID NO: 1590 - protein, 7 aa, Artificial Sequence
  Description of Artificial Sequence: Synthetic peptide
ATKPQHY

SEQ ID NO: 1591 - protein, 7 aa, Artificial Sequence
  Description of Artificial Sequence: Synthetic peptide
ATKPQPY

SEQ ID NO: 1592 - protein, 7 aa, Artificial Sequence
  Description of Artificial Sequence: Synthetic peptide
ATKPQKY

SEQ ID NO: 1593 - protein, 6 aa, Artificial Sequence
  Description of Artificial Sequence: Synthetic peptide
ATKPNY

SEQ ID NO: 1594 - protein, 7 aa, Artificial Sequence
  Description of Artificial Sequence: Synthetic peptide
ATKPNRY

SEQ ID NO: 1595 - protein, 7 aa, Artificial Sequence
  Description of Artificial Sequence: Synthetic peptide
ATKPNFY

SEQ ID NO: 1596 - protein, 7 aa, Artificial Sequence
  Description of Artificial Sequence: Synthetic peptide
ATKPNYY

SEQ ID NO: 1597 - protein, 7 aa, Artificial Sequence
  Description of Artificial Sequence: Synthetic peptide
ATKPNHY

SEQ ID NO: 1598 - protein, 7 aa, Artificial Sequence
  Description of Artificial Sequence: Synthetic peptide
ATKPNPY

SEQ ID NO: 1599 - protein, 7 aa, Artificial Sequence
  Description of Artificial Sequence: Synthetic peptide
ATKPNKY

SEQ ID NO: 1600 - protein, 6 aa, Artificial Sequence
  Description of Artificial Sequence: Synthetic peptide
ATKPYY

SEQ ID NO: 1601 - protein, 7 aa, Artificial Sequence
  Description of Artificial Sequence: Synthetic peptide
ATKPYRY

SEQ ID NO: 1602 - protein, 7 aa, Artificial Sequence
  Description of Artificial Sequence: Synthetic peptide
ATKPYFY

SEQ ID NO: 1603 - protein, 7 aa, Artificial Sequence
  Description of Artificial Sequence: Synthetic peptide
ATKPYYY

SEQ ID NO: 1604 - protein, 7 aa, Artificial Sequence
  Description of Artificial Sequence: Synthetic peptide
ATKPYHY

SEQ ID NO: 1605 - protein, 7 aa, Artificial Sequence
  Description of Artificial Sequence: Synthetic peptide
ATKPYPY

SEQ ID NO: 1606 - protein, 7 aa, Artificial Sequence
  Description of Artificial Sequence: Synthetic peptide
ATKPYKY

SEQ ID NO: 1607 - protein, 6 aa, Artificial Sequence
  Description of Artificial Sequence: Synthetic peptide
ATKPRY

SEQ ID NO: 1608 - protein, 7 aa, Artificial Sequence
  Description of Artificial Sequence: Synthetic peptide
ATKPRRY

SEQ ID NO: 1609 - protein, 7 aa, Artificial Sequence
  Description of Artificial Sequence: Synthetic peptide
ATKPRFY

SEQ ID NO: 1610 - protein, 7 aa, Artificial Sequence
  Description of Artificial Sequence: Synthetic peptide
ATKPRYY

SEQ ID NO: 1611 - protein, 7 aa, Artificial Sequence
  Description of Artificial Sequence: Synthetic peptide
ATKPRHY

SEQ ID NO: 1612 - protein, 7 aa, Artificial Sequence
  Description of Artificial Sequence: Synthetic peptide
ATKPRPY

SEQ ID NO: 1613 - protein, 7 aa, Artificial Sequence
  Description of Artificial Sequence: Synthetic peptide
ATKPRKY

SEQ ID NO: 1614 - protein, 5 aa, Artificial Sequence
  Description of Artificial Sequence: Synthetic peptide
HTKPY

SEQ ID NO: 1615 - protein, 6 aa, Artificial Sequence
  Description of Artificial Sequence: Synthetic peptide
HTKPRY

SEQ ID NO: 1616 - protein, 6 aa, Artificial Sequence
  Description of Artificial Sequence: Synthetic peptide
HTKPFY

SEQ ID NO: 1617 - protein, 6 aa, Artificial Sequence
  Description of Artificial Sequence: Synthetic peptide
HTKPYY

SEQ ID NO: 1618 - protein, 6 aa, Artificial Sequence
  Description of Artificial Sequence: Synthetic peptide
HTKPGY

SEQ ID NO: 1619 - protein, 6 aa, Artificial Sequence
  Description of Artificial Sequence: Synthetic peptide
HTKPHY

SEQ ID NO: 1620 - protein, 6 aa, Artificial Sequence
  Description of Artificial Sequence: Synthetic peptide
HTKPKY

SEQ ID NO: 1621 - protein, 6 aa, Artificial Sequence
  Description of Artificial Sequence: Synthetic peptide
HTKPGY

SEQ ID NO: 1622 - protein, 7 aa, Artificial Sequence
  Description of Artificial Sequence: Synthetic peptide
HTKPGRY

SEQ ID NO: 1623 - protein, 7 aa, Artificial Sequence
  Description of Artificial Sequence: Synthetic peptide
HTKPGFY

SEQ ID NO: 1624 - protein, 7 aa, Artificial Sequence
  Description of Artificial Sequence: Synthetic peptide
HTKPGYY

SEQ ID NO: 1625 - protein, 7 aa, Artificial Sequence
  Description of Artificial Sequence: Synthetic peptide
HTKPGHY

SEQ ID NO: 1626 - protein, 7 aa, Artificial Sequence
  Description of Artificial Sequence: Synthetic peptide
HTKPGPY

SEQ ID NO: 1627 - protein, 7 aa, Artificial Sequence
  Description of Artificial Sequence: Synthetic peptide
HTKPGKY

SEQ ID NO: 1628 - protein, 6 aa, Artificial Sequence
  Description of Artificial Sequence: Synthetic peptide
HTKPDY

SEQ ID NO: 1629 - protein, 7 aa, Artificial Sequence
  Description of Artificial Sequence: Synthetic peptide
HTKPDRY

SEQ ID NO: 1630 - protein, 7 aa, Artificial Sequence
  Description of Artificial Sequence: Synthetic peptide
HTKPDFY

SEQ ID NO: 1631 - protein, 7 aa, Artificial Sequence
  Description of Artificial Sequence: Synthetic peptide
HTKPDYY

SEQ ID NO: 1632 - protein, 7 aa, Artificial Sequence
  Description of Artificial Sequence: Synthetic peptide
HTKPDHY

SEQ ID NO: 1633 - protein, 7 aa, Artificial Sequence
  Description of Artificial Sequence: Synthetic peptide
HTKPDPY

SEQ ID NO: 1634 - protein, 7 aa, Artificial Sequence
  Description of Artificial Sequence: Synthetic peptide
HTKPDKY

SEQ ID NO: 1635 - protein, 6 aa, Artificial Sequence
  Description of Artificial Sequence: Synthetic peptide
HTKPWY

SEQ ID NO: 1636 - protein, 7 aa, Artificial Sequence
  Description of Artificial Sequence: Synthetic peptide
HTKPWRY

SEQ ID NO: 1637 - protein, 7 aa, Artificial Sequence
  Description of Artificial Sequence: Synthetic peptide
HTKPWFY

SEQ ID NO: 1638 - protein, 7 aa, Artificial Sequence
  Description of Artificial Sequence: Synthetic peptide
HTKPWYY

SEQ ID NO: 1639 - protein, 7 aa, Artificial Sequence
  Description of Artificial Sequence: Synthetic peptide
HTKPWHY

SEQ ID NO: 1640 - protein, 7 aa, Artificial Sequence
  Description of Artificial Sequence: Synthetic peptide
HTKPWPY

SEQ ID NO: 1641 - protein, 7 aa, Artificial Sequence
  Description of Artificial Sequence: Synthetic peptide
HTKPWKY

SEQ ID NO: 1642 - protein, 6 aa, Artificial Sequence
  Description of Artificial Sequence: Synthetic peptide
HTKPQY

SEQ ID NO: 1643 - protein, 7 aa, Artificial Sequence
  Description of Artificial Sequence: Synthetic peptide
HTKPQRY

SEQ ID NO: 1644 - protein, 7 aa, Artificial Sequence
  Description of Artificial Sequence: Synthetic peptide
HTKPQFY

SEQ ID NO: 1645 - protein, 7 aa, Artificial Sequence
  Description of Artificial Sequence: Synthetic peptide
HTKPQYY

SEQ ID NO: 1646 - protein, 7 aa, Artificial Sequence
  Description of Artificial Sequence: Synthetic peptide
HTKPQHY

SEQ ID NO: 1647 - protein, 7 aa, Artificial Sequence
  Description of Artificial Sequence: Synthetic peptide
HTKPQPY

SEQ ID NO: 1648 - protein, 7 aa, Artificial Sequence
  Description of Artificial Sequence: Synthetic peptide
HTKPQKY

SEQ ID NO: 1649 - protein, 6 aa, Artificial Sequence
  Description of Artificial Sequence: Synthetic peptide
HTKPNY

SEQ ID NO: 1650 - protein, 7 aa, Artificial Sequence
  Description of Artificial Sequence: Synthetic peptide
HTKPNRY

SEQ ID NO: 1651 - protein, 7 aa, Artificial Sequence
  Description of Artificial Sequence: Synthetic peptide
HTKPNFY

SEQ ID NO: 1652 - protein, 7 aa, Artificial Sequence
  Description of Artificial Sequence: Synthetic peptide
HTKPNYY

SEQ ID NO: 1653 - protein, 7 aa, Artificial Sequence
  Description of Artificial Sequence: Synthetic peptide
HTKPNHY

SEQ ID NO: 1654 - protein, 7 aa, Artificial Sequence
  Description of Artificial Sequence: Synthetic peptide
HTKPNPY

SEQ ID NO: 1655 - protein, 7 aa, Artificial Sequence
  Description of Artificial Sequence: Synthetic peptide
HTKPNKY

SEQ ID NO: 1656 - protein, 6 aa, Artificial Sequence
  Description of Artificial Sequence: Synthetic peptide
HTKPYY

SEQ ID NO: 1657 - protein, 7 aa, Artificial Sequence
  Description of Artificial Sequence: Synthetic peptide
HTKPYRY

SEQ ID NO: 1658 - protein, 7 aa, Artificial Sequence
  Description of Artificial Sequence: Synthetic peptide
HTKPYFY

SEQ ID NO: 1659 - protein, 7 aa, Artificial Sequence
  Description of Artificial Sequence: Synthetic peptide
HTKPYYY

SEQ ID NO: 1660 - protein, 7 aa, Artificial Sequence
  Description of Artificial Sequence: Synthetic peptide
HTKPYHY

SEQ ID NO: 1661 - protein, 7 aa, Artificial Sequence
  Description of Artificial Sequence: Synthetic peptide
HTKPYPY

SEQ ID NO: 1662 - protein, 7 aa, Artificial Sequence
  Description of Artificial Sequence: Synthetic peptide
HTKPYKY

SEQ ID NO: 1663 - protein, 6 aa, Artificial Sequence
  Description of Artificial Sequence: Synthetic peptide
HTKPRY

SEQ ID NO: 1664 - protein, 7 aa, Artificial Sequence
  Description of Artificial Sequence: Synthetic peptide
HTKPRRY

SEQ ID NO: 1665 - protein, 7 aa, Artificial Sequence
  Description of Artificial Sequence: Synthetic peptide
HTKPRFY

SEQ ID NO: 1666 - protein, 7 aa, Artificial Sequence
  Description of Artificial Sequence: Synthetic peptide
HTKPRYY

SEQ ID NO: 1667 - protein, 7 aa, Artificial Sequence
  Description of Artificial Sequence: Synthetic peptide
HTKPRHY

SEQ ID NO: 1668 - protein, 7 aa, Artificial Sequence
  Description of Artificial Sequence: Synthetic peptide
HTKPRPY

SEQ ID NO: 1669 - protein, 7 aa, Artificial Sequence
  Description of Artificial Sequence: Synthetic peptide
HTKPRKY

SEQ ID NO: 1670 - protein, 5 aa, Artificial Sequence
  Description of Artificial Sequence: Synthetic peptide
KTKPY

SEQ ID NO: 1671 - protein, 6 aa, Artificial Sequence
  Description of Artificial Sequence: Synthetic peptide
KTKPRY

SEQ ID NO: 1672 - protein, 6 aa, Artificial Sequence
  Description of Artificial Sequence: Synthetic peptide
KTKPFY

SEQ ID NO: 1673 - protein, 6 aa, Artificial Sequence
  Description of Artificial Sequence: Synthetic peptide
KTKPYY

SEQ ID NO: 1674 - protein, 6 aa, Artificial Sequence
  Description of Artificial Sequence: Synthetic peptide
KTKPGY

SEQ ID NO: 1675 - protein, 6 aa, Artificial Sequence
  Description of Artificial Sequence: Synthetic peptide
KTKPHY

SEQ ID NO: 1676 - protein, 6 aa, Artificial Sequence
  Description of Artificial Sequence: Synthetic peptide
KTKPKY

SEQ ID NO: 1677 - protein, 6 aa, Artificial Sequence
  Description of Artificial Sequence: Synthetic peptide
KTKPGY

SEQ ID NO: 1678 - protein, 7 aa, Artificial Sequence
  Description of Artificial Sequence: Synthetic peptide
KTKPGRY

SEQ ID NO: 1679 - protein, 7 aa, Artificial Sequence
  Description of Artificial Sequence: Synthetic peptide
KTKPGFY

SEQ ID NO: 1680 - protein, 7 aa, Artificial Sequence
  Description of Artificial Sequence: Synthetic peptide
KTKPGYY

SEQ ID NO: 1681 - protein, 7 aa, Artificial Sequence
  Description of Artificial Sequence: Synthetic peptide
KTKPGHY

SEQ ID NO: 1682 - protein, 7 aa, Artificial Sequence
  Description of Artificial Sequence: Synthetic peptide
KTKPGPY

SEQ ID NO: 1683 - protein, 7 aa, Artificial Sequence
  Description of Artificial Sequence: Synthetic peptide
KTKPGKY

SEQ ID NO: 1684 - protein, 6 aa, Artificial Sequence
  Description of Artificial Sequence: Synthetic peptide
KTKPDY

SEQ ID NO: 1685 - protein, 7 aa, Artificial Sequence
  Description of Artificial Sequence: Synthetic peptide
KTKPDRY

SEQ ID NO: 1686 - protein, 7 aa, Artificial Sequence
  Description of Artificial Sequence: Synthetic peptide
KTKPDFY

SEQ ID NO: 1687 - protein, 7 aa, Artificial Sequence
  Description of Artificial Sequence: Synthetic peptide
KTKPDYY

SEQ ID NO: 1688 - protein, 7 aa, Artificial Sequence
  Description of Artificial Sequence: Synthetic peptide
KTKPDHY

SEQ ID NO: 1689 - protein, 7 aa, Artificial Sequence
  Description of Artificial Sequence: Synthetic peptide
KTKPDPY

SEQ ID NO: 1690 - protein, 7 aa, Artificial Sequence
  Description of Artificial Sequence: Synthetic peptide
KTKPDKY

SEQ ID NO: 1691 - protein, 6 aa, Artificial Sequence
  Description of Artificial Sequence: Synthetic peptide
KTKPWY

SEQ ID NO: 1692 - protein, 7 aa, Artificial Sequence
  Description of Artificial Sequence: Synthetic peptide
KTKPWRY

SEQ ID NO: 1693 - protein, 7 aa, Artificial Sequence
  Description of Artificial Sequence: Synthetic peptide
KTKPWFY

SEQ ID NO: 1694 - protein, 7 aa, Artificial Sequence
  Description of Artificial Sequence: Synthetic peptide
KTKPWYY

SEQ ID NO: 1695 - protein, 7 aa, Artificial Sequence
  Description of Artificial Sequence: Synthetic peptide
KTKPWHY

SEQ ID NO: 1696 - protein, 7 aa, Artificial Sequence
  Description of Artificial Sequence: Synthetic peptide
KTKPWPY

SEQ ID NO: 1697 - protein, 7 aa, Artificial Sequence
  Description of Artificial Sequence: Synthetic peptide
KTKPWKY

SEQ ID NO: 1698 - protein, 6 aa, Artificial Sequence
  Description of Artificial Sequence: Synthetic peptide
KTKPQY

SEQ ID NO: 1699 - protein, 7 aa, Artificial Sequence
  Description of Artificial Sequence: Synthetic peptide
KTKPQRY

SEQ ID NO: 1700 - protein, 7 aa, Artificial Sequence
  Description of Artificial Sequence: Synthetic peptide
KTKPQFY

SEQ ID NO: 1701 - protein, 7 aa, Artificial Sequence
  Description of Artificial Sequence: Synthetic peptide
KTKPQYY

SEQ ID NO: 1702 - protein, 7 aa, Artificial Sequence
  Description of Artificial Sequence: Synthetic peptide
KTKPQHY

SEQ ID NO: 1703 - protein, 7 aa, Artificial Sequence
  Description of Artificial Sequence: Synthetic peptide
KTKPQPY

SEQ ID NO: 1704 - protein, 7 aa, Artificial Sequence
  Description of Artificial Sequence: Synthetic peptide
KTKPQKY

SEQ ID NO: 1705 - protein, 6 aa, Artificial Sequence
  Description of Artificial Sequence: Synthetic peptide
KTKPNY

SEQ ID NO: 1706 - protein, 7 aa, Artificial Sequence
  Description of Artificial Sequence: Synthetic peptide
KTKPNRY

SEQ ID NO: 1707 - protein, 7 aa, Artificial Sequence
  Description of Artificial Sequence: Synthetic peptide
KTKPNFY

SEQ ID NO: 1708 - protein, 7 aa, Artificial Sequence
  Description of Artificial Sequence: Synthetic peptide
KTKPNYY

SEQ ID NO: 1709 - protein, 7 aa, Artificial Sequence
  Description of Artificial Sequence: Synthetic peptide
KTKPNHY

SEQ ID NO: 1710 - protein, 7 aa, Artificial Sequence
  Description of Artificial Sequence: Synthetic peptide
KTKPNPY

SEQ ID NO: 1711 - protein, 7 aa, Artificial Sequence
  Description of Artificial Sequence: Synthetic peptide
KTKPNKY

SEQ ID NO: 1712 - protein, 6 aa, Artificial Sequence
  Description of Artificial Sequence: Synthetic peptide
KTKPYY

SEQ ID NO: 1713 - protein, 7 aa, Artificial Sequence
  Description of Artificial Sequence: Synthetic peptide
KTKPYRY

SEQ ID NO: 1714 - protein, 7 aa, Artificial Sequence
  Description of Artificial Sequence: Synthetic peptide
KTKPYFY

SEQ ID NO: 1715 - protein, 7 aa, Artificial Sequence
  Description of Artificial Sequence: Synthetic peptide
KTKPYYY

SEQ ID NO: 1716 - protein, 7 aa, Artificial Sequence
  Description of Artificial Sequence: Synthetic peptide
KTKPYHY

SEQ ID NO: 1717 - protein, 7 aa, Artificial Sequence
  Description of Artificial Sequence: Synthetic peptide
KTKPYPY

SEQ ID NO: 1718 - protein, 7 aa, Artificial Sequence
  Description of Artificial Sequence: Synthetic peptide
KTKPYKY

SEQ ID NO: 1719 - protein, 6 aa, Artificial Sequence
  Description of Artificial Sequence: Synthetic peptide
KTKPRY

SEQ ID NO: 1720 - protein, 7 aa, Artificial Sequence
  Description of Artificial Sequence: Synthetic peptide
KTKPRRY

SEQ ID NO: 1721 - protein, 7 aa, Artificial Sequence
  Description of Artificial Sequence: Synthetic peptide
KTKPRFY

SEQ ID NO: 1722 - protein, 7 aa, Artificial Sequence
  Description of Artificial Sequence: Synthetic peptide
KTKPRYY

SEQ ID NO: 1723 - protein, 7 aa, Artificial Sequence
  Description of Artificial Sequence: Synthetic peptide
KTKPRHY

SEQ ID NO: 1724 - protein, 7 aa, Artificial Sequence
  Description of Artificial Sequence: Synthetic peptide
KTKPRPY

SEQ ID NO: 1725 - protein, 7 aa, Artificial Sequence
  Description of Artificial Sequence: Synthetic peptide
KTKPRKY

SEQ ID NO: 1726 - protein, 5 aa, Artificial Sequence
  Description of Artificial Sequence: Synthetic peptide
GTKPY

SEQ ID NO: 1727 - protein, 6 aa, Artificial Sequence
  Description of Artificial Sequence: Synthetic peptide
GTKPRY

SEQ ID NO: 1728 - protein, 6 aa, Artificial Sequence
  Description of Artificial Sequence: Synthetic peptide
GTKPFY

SEQ ID NO: 1729 - protein, 6 aa, Artificial Sequence
  Description of Artificial Sequence: Synthetic peptide
GTKPYY

SEQ ID NO: 1730 - protein, 6 aa, Artificial Sequence
  Description of Artificial Sequence: Synthetic peptide
GTKPGY

SEQ ID NO: 1731 - protein, 6 aa, Artificial Sequence
  Description of Artificial Sequence: Synthetic peptide
GTKPHY

SEQ ID NO: 1732 - protein, 6 aa, Artificial Sequence
  Description of Artificial Sequence: Synthetic peptide
GTKPKY

SEQ ID NO: 1733 - protein, 6 aa, Artificial Sequence
  Description of Artificial Sequence: Synthetic peptide
GTKPGY

SEQ ID NO: 1734 - protein, 7 aa, Artificial Sequence
  Description of Artificial Sequence: Synthetic peptide
GTKPGRY

SEQ ID NO: 1735 - protein, 7 aa, Artificial Sequence
  Description of Artificial Sequence: Synthetic peptide
GTKPGFY

SEQ ID NO: 1736 - protein, 7 aa, Artificial Sequence
  Description of Artificial Sequence: Synthetic peptide
GTKPGYY

SEQ ID NO: 1737 - protein, 7 aa, Artificial Sequence
  Description of Artificial Sequence: Synthetic peptide
GTKPGHY

SEQ ID NO: 1738 - protein, 7 aa, Artificial Sequence
  Description of Artificial Sequence: Synthetic peptide
GTKPGPY

SEQ ID NO: 1739 - protein, 7 aa, Artificial Sequence
  Description of Artificial Sequence: Synthetic peptide
GTKPGKY

SEQ ID NO: 1740 - protein, 6 aa, Artificial Sequence
  Description of Artificial Sequence: Synthetic peptide
GTKPDY

SEQ ID NO: 1741 - protein, 7 aa, Artificial Sequence
  Description of Artificial Sequence: Synthetic peptide
GTKPDRY

SEQ ID NO: 1742 - protein, 7 aa, Artificial Sequence
  Description of Artificial Sequence: Synthetic peptide
GTKPDFY

SEQ ID NO: 1743 - protein, 7 aa, Artificial Sequence
  Description of Artificial Sequence: Synthetic peptide
GTKPDYY

SEQ ID NO: 1744 - protein, 7 aa, Artificial Sequence
  Description of Artificial Sequence: Synthetic peptide
GTKPDHY

SEQ ID NO: 1745 - protein, 7 aa, Artificial Sequence
  Description of Artificial Sequence: Synthetic peptide
GTKPDPY

SEQ ID NO: 1746 - protein, 7 aa, Artificial Sequence
  Description of Artificial Sequence: Synthetic peptide
GTKPDKY

SEQ ID NO: 1747 - protein, 6 aa, Artificial Sequence
  Description of Artificial Sequence: Synthetic peptide
GTKPWY

SEQ ID NO: 1748 - protein, 7 aa, Artificial Sequence
  Description of Artificial Sequence: Synthetic peptide
GTKPWRY

SEQ ID NO: 1749 - protein, 7 aa, Artificial Sequence
  Description of Artificial Sequence: Synthetic peptide
GTKPWFY

SEQ ID NO: 1750 - protein, 7 aa, Artificial Sequence
  Description of Artificial Sequence: Synthetic peptide
GTKPWYY

SEQ ID NO: 1751 - protein, 7 aa, Artificial Sequence
  Description of Artificial Sequence: Synthetic peptide
GTKPWHY

SEQ ID NO: 1752 - protein, 7 aa, Artificial Sequence
  Description of Artificial Sequence: Synthetic peptide
GTKPWPY

SEQ ID NO: 1753 - protein, 7 aa, Artificial Sequence
  Description of Artificial Sequence: Synthetic peptide
GTKPWKY

SEQ ID NO: 1754 - protein, 6 aa, Artificial Sequence
  Description of Artificial Sequence: Synthetic peptide
GTKPQY

SEQ ID NO: 1755 - protein, 7 aa, Artificial Sequence
  Description of Artificial Sequence: Synthetic peptide
GTKPQRY

SEQ ID NO: 1756 - protein, 7 aa, Artificial Sequence
  Description of Artificial Sequence: Synthetic peptide
GTKPQFY

SEQ ID NO: 1757 - protein, 7 aa, Artificial Sequence
  Description of Artificial Sequence: Synthetic peptide
GTKPQYY

SEQ ID NO: 1758 - protein, 7 aa, Artificial Sequence
  Description of Artificial Sequence: Synthetic peptide
GTKPQHY

SEQ ID NO: 1759 - protein, 7 aa, Artificial Sequence
  Description of Artificial Sequence: Synthetic peptide
GTKPQPY

SEQ ID NO: 1760 - protein, 7 aa, Artificial Sequence
  Description of Artificial Sequence: Synthetic peptide
GTKPQKY

SEQ ID NO: 1761 - protein, 6 aa, Artificial Sequence
  Description of Artificial Sequence: Synthetic peptide
GTKPNY

SEQ ID NO: 1762 - protein, 7 aa, Artificial Sequence
  Description of Artificial Sequence: Synthetic peptide
GTKPNRY

SEQ ID NO: 1763 - protein, 7 aa, Artificial Sequence
  Description of Artificial Sequence: Synthetic peptide
GTKPNFY

SEQ ID NO: 1764 - protein, 7 aa, Artificial Sequence
  Description of Artificial Sequence: Synthetic peptide
GTKPNYY

SEQ ID NO: 1765 - protein, 7 aa, Artificial Sequence
  Description of Artificial Sequence: Synthetic peptide
GTKPNHY

SEQ ID NO: 1766 - protein, 7 aa, Artificial Sequence
  Description of Artificial Sequence: Synthetic peptide
GTKPNPY

SEQ ID NO: 1767 - protein, 7 aa, Artificial Sequence
  Description of Artificial Sequence: Synthetic peptide
GTKPNKY

SEQ ID NO: 1768 - protein, 6 aa, Artificial Sequence
  Description of Artificial Sequence: Synthetic peptide
GTKPYY

SEQ ID NO: 1769 - protein, 7 aa, Artificial Sequence
  Description of Artificial Sequence: Synthetic peptide
GTKPYRY

SEQ ID NO: 1770 - protein, 7 aa, Artificial Sequence
  Description of Artificial Sequence: Synthetic peptide
GTKPYFY

SEQ ID NO: 1771 - protein, 7 aa, Artificial Sequence
  Description of Artificial Sequence: Synthetic peptide
GTKPYYY

SEQ ID NO: 1772 - protein, 7 aa, Artificial Sequence
  Description of Artificial Sequence: Synthetic peptide
GTKPYHY

SEQ ID NO: 1773 - protein, 7 aa, Artificial Sequence
  Description of Artificial Sequence: Synthetic peptide
GTKPYPY

SEQ ID NO: 1774 - protein, 7 aa, Artificial Sequence
  Description of Artificial Sequence: Synthetic peptide
GTKPYKY

SEQ ID NO: 1775 - protein, 6 aa, Artificial Sequence
  Description of Artificial Sequence: Synthetic peptide
GTKPRY

SEQ ID NO: 1776 - protein, 7 aa, Artificial Sequence
  Description of Artificial Sequence: Synthetic peptide
GTKPRRY

SEQ ID NO: 1777 - protein, 7 aa, Artificial Sequence
  Description of Artificial Sequence: Synthetic peptide
GTKPRFY

SEQ ID NO: 1778 - protein, 7 aa, Artificial Sequence
  Description of Artificial Sequence: Synthetic peptide
GTKPRYY

SEQ ID NO: 1779 - protein, 7 aa, Artificial Sequence
  Description of Artificial Sequence: Synthetic peptide
GTKPRHY

SEQ ID NO: 1780 - protein, 7 aa, Artificial Sequence
  Description of Artificial Sequence: Synthetic peptide
GTKPRPY

SEQ ID NO: 1781 - protein, 7 aa, Artificial Sequence
  Description of Artificial Sequence: Synthetic peptide
GTKPRKY

SEQ ID NO: 1782 - protein, 5 aa, Artificial Sequence
  Description of Artificial Sequence: Synthetic peptide
TKPRW

SEQ ID NO: 1783 - protein, 5 aa, Artificial Sequence
  Description of Artificial Sequence: Synthetic peptide
TKPFW

SEQ ID NO: 1784 - protein, 5 aa, Artificial Sequence
  Description of Artificial Sequence: Synthetic peptide
TKPYW

SEQ ID NO: 1785 - protein, 5 aa, Artificial Sequence
  Description of Artificial Sequence: Synthetic peptide
TKPGW

SEQ ID NO: 1786 - protein, 5 aa, Artificial Sequence
  Description of Artificial Sequence: Synthetic peptide
TKPHW

SEQ ID NO: 1787 - protein, 5 aa, Artificial Sequence
  Description of Artificial Sequence: Synthetic peptide
TKPKW

SEQ ID NO: 1788 - protein, 5 aa, Artificial Sequence
  Description of Artificial Sequence: Synthetic peptide
TKPGW

SEQ ID NO: 1789 - protein, 6 aa, Artificial Sequence
  Description of Artificial Sequence: Synthetic peptide
TKPGRW

SEQ ID NO: 1790 - protein, 6 aa, Artificial Sequence
  Description of Artificial Sequence: Synthetic peptide
TKPGFW

SEQ ID NO: 1791 - protein, 6 aa, Artificial Sequence
  Description of Artificial Sequence: Synthetic peptide
TKPGYW

SEQ ID NO: 1792 - protein, 6 aa, Artificial Sequence
  Description of Artificial Sequence: Synthetic peptide
TKPGHW

SEQ ID NO: 1793 - protein, 6 aa, Artificial Sequence
  Description of Artificial Sequence: Synthetic peptide
TKPGPW

SEQ ID NO: 1794 - protein, 6 aa, Artificial Sequence
  Description of Artificial Sequence: Synthetic peptide
TKPGKW

SEQ ID NO: 1795 - protein, 5 aa, Artificial Sequence
  Description of Artificial Sequence: Synthetic peptide
TKPDW

SEQ ID NO: 1796 - protein, 6 aa, Artificial Sequence
  Description of Artificial Sequence: Synthetic peptide
TKPDRW

SEQ ID NO: 1797 - protein, 6 aa, Artificial Sequence
  Description of Artificial Sequence: Synthetic peptide
TKPDFW

SEQ ID NO: 1798 - protein, 6 aa, Artificial Sequence
  Description of Artificial Sequence: Synthetic peptide
TKPDYW

SEQ ID NO: 1799 - protein, 6 aa, Artificial Sequence
  Description of Artificial Sequence: Synthetic peptide
TKPDHW

SEQ ID NO: 1800 - protein, 6 aa, Artificial Sequence
  Description of Artificial Sequence: Synthetic peptide
TKPDPW

SEQ ID NO: 1801 - protein, 6 aa, Artificial Sequence
  Description of Artificial Sequence: Synthetic peptide
TKPDKW

SEQ ID NO: 1802 - protein, 5 aa, Artificial Sequence
  Description of Artificial Sequence: Synthetic peptide
TKPWW

SEQ ID NO: 1803 - protein, 6 aa, Artificial Sequence
  Description of Artificial Sequence: Synthetic peptide
TKPWRW

SEQ ID NO: 1804 - protein, 6 aa, Artificial Sequence
  Description of Artificial Sequence: Synthetic peptide
TKPWFW

SEQ ID NO: 1805 - protein, 6 aa, Artificial Sequence
  Description of Artificial Sequence: Synthetic peptide
TKPWYW

SEQ ID NO: 1806 - protein, 6 aa, Artificial Sequence
  Description of Artificial Sequence: Synthetic peptide
TKPWHW

SEQ ID NO: 1807 - protein, 6 aa, Artificial Sequence
  Description of Artificial Sequence: Synthetic peptide
TKPWPW

SEQ ID NO: 1808 - protein, 6 aa, Artificial Sequence
  Description of Artificial Sequence: Synthetic peptide
TKPWKW

SEQ ID NO: 1809 - protein, 5 aa, Artificial Sequence
  Description of Artificial Sequence: Synthetic peptide
TKPQW

SEQ ID NO: 1810 - protein, 6 aa, Artificial Sequence
  Description of Artificial Sequence: Synthetic peptide
TKPQRW

SEQ ID NO: 1811 - protein, 6 aa, Artificial Sequence
  Description of Artificial Sequence: Synthetic peptide
TKPQFW

SEQ ID NO: 1812 - protein, 6 aa, Artificial Sequence
  Description of Artificial Sequence: Synthetic peptide
TKPQYW

SEQ ID NO: 1813 - protein, 6 aa, Artificial Sequence
  Description of Artificial Sequence: Synthetic peptide
TKPQHW

SEQ ID NO: 1814 - protein, 6 aa, Artificial Sequence
  Description of Artificial Sequence: Synthetic peptide
TKPQPW

SEQ ID NO: 1815 - protein, 6 aa, Artificial Sequence
  Description of Artificial Sequence: Synthetic peptide
TKPQKW

SEQ ID NO: 1816 - protein, 5 aa, Artificial Sequence
  Description of Artificial Sequence: Synthetic peptide
TKPNW

SEQ ID NO: 1817 - protein, 6 aa, Artificial Sequence
  Description of Artificial Sequence: Synthetic peptide
TKPNRW

SEQ ID NO: 1818 - protein, 6 aa, Artificial Sequence
  Description of Artificial Sequence: Synthetic peptide
TKPNFW

SEQ ID NO: 1819 - protein, 6 aa, Artificial Sequence
  Description of Artificial Sequence: Synthetic peptide
TKPNYW

SEQ ID NO: 1820 - protein, 6 aa, Artificial Sequence
  Description of Artificial Sequence: Synthetic peptide
TKPNHW

SEQ ID NO: 1821 - protein, 6 aa, Artificial Sequence
  Description of Artificial Sequence: Synthetic peptide
TKPNPW

SEQ ID NO: 1822 - protein, 6 aa, Artificial Sequence
  Description of Artificial Sequence: Synthetic peptide
TKPNKW

SEQ ID NO: 1823 - protein, 5 aa, Artificial Sequence
  Description of Artificial Sequence: Synthetic peptide
TKPYW

SEQ ID NO: 1824 - protein, 6 aa, Artificial Sequence
  Description of Artificial Sequence: Synthetic peptide
TKPYRW

SEQ ID NO: 1825 - protein, 6 aa, Artificial Sequence
  Description of Artificial Sequence: Synthetic peptide
TKPYFW

SEQ ID NO: 1826 - protein, 6 aa, Artificial Sequence
  Description of Artificial Sequence: Synthetic peptide
TKPYYW

SEQ ID NO: 1827 - protein, 6 aa, Artificial Sequence
  Description of Artificial Sequence: Synthetic peptide
TKPYHW

SEQ ID NO: 1828 - protein, 6 aa, Artificial Sequence
  Description of Artificial Sequence: Synthetic peptide
TKPYPW

SEQ ID NO: 1829 - protein, 6 aa, Artificial Sequence
  Description of Artificial Sequence: Synthetic peptide
TKPYKW

SEQ ID NO: 1830 - protein, 5 aa, Artificial Sequence
  Description of Artificial Sequence: Synthetic peptide
TKPRW

SEQ ID NO: 1831 - protein, 6 aa, Artificial Sequence
  Description of Artificial Sequence: Synthetic peptide
TKPRRW

SEQ ID NO: 1832 - protein, 6 aa, Artificial Sequence
  Description of Artificial Sequence: Synthetic peptide
TKPRFW

SEQ ID NO: 1833 - protein, 6 aa, Artificial Sequence
  Description of Artificial Sequence: Synthetic peptide
TKPRYW

SEQ ID NO: 1834 - protein, 6 aa, Artificial Sequence
  Description of Artificial Sequence: Synthetic peptide
TKPRHW

SEQ ID NO: 1835 - protein, 6 aa, Artificial Sequence
  Description of Artificial Sequence: Synthetic peptide
TKPRPW

SEQ ID NO: 1836 - protein, 6 aa, Artificial Sequence
  Description of Artificial Sequence: Synthetic peptide
TKPRKW

SEQ ID NO: 1837 - protein, 5 aa, Artificial Sequence
  Description of Artificial Sequence: Synthetic peptide
MTKPW

SEQ ID NO: 1838 - protein, 6 aa, Artificial Sequence
  Description of Artificial Sequence: Synthetic peptide
MTKPRW

SEQ ID NO: 1839 - protein, 6 aa, Artificial Sequence
  Description of Artificial Sequence: Synthetic peptide
MTKPFW

SEQ ID NO: 1840 - protein, 6 aa, Artificial Sequence
  Description of Artificial Sequence: Synthetic peptide
MTKPYW

SEQ ID NO: 1841 - protein, 6 aa, Artificial Sequence
  Description of Artificial Sequence: Synthetic peptide
MTKPGW

SEQ ID NO: 1842 - protein, 6 aa, Artificial Sequence
  Description of Artificial Sequence: Synthetic peptide
MTKPHW

SEQ ID NO: 1843 - protein, 6 aa, Artificial Sequence
  Description of Artificial Sequence: Synthetic peptide
MTKPKW

SEQ ID NO: 1844 - protein, 6 aa, Artificial Sequence
  Description of Artificial Sequence: Synthetic peptide
MTKPGW

SEQ ID NO: 1845 - protein, 7 aa, Artificial Sequence
  Description of Artificial Sequence: Synthetic peptide
MTKPGRW

SEQ ID NO: 1846 - protein, 7 aa, Artificial Sequence
  Description of Artificial Sequence: Synthetic peptide
MTKPGFW

SEQ ID NO: 1847 - protein, 7 aa, Artificial Sequence
  Description of Artificial Sequence: Synthetic peptide
MTKPGYW

SEQ ID NO: 1848 - protein, 7 aa, Artificial Sequence
  Description of Artificial Sequence: Synthetic peptide
MTKPGHW

SEQ ID NO: 1849 - protein, 7 aa, Artificial Sequence
  Description of Artificial Sequence: Synthetic peptide
MTKPGPW

SEQ ID NO: 1850 - protein, 7 aa, Artificial Sequence
  Description of Artificial Sequence: Synthetic peptide
MTKPGKW

SEQ ID NO: 1851 - protein, 6 aa, Artificial Sequence
  Description of Artificial Sequence: Synthetic peptide
MTKPDW

SEQ ID NO: 1852 - protein, 7 aa, Artificial Sequence
  Description of Artificial Sequence: Synthetic peptide
MTKPDRW

SEQ ID NO: 1853 - protein, 7 aa, Artificial Sequence
  Description of Artificial Sequence: Synthetic peptide
MTKPDFW

SEQ ID NO: 1854 - protein, 7 aa, Artificial Sequence
  Description of Artificial Sequence: Synthetic peptide
MTKPDYW

SEQ ID NO: 1855 - protein, 7 aa, Artificial Sequence
  Description of Artificial Sequence: Synthetic peptide
MTKPDHW

SEQ ID NO: 1856 - protein, 7 aa, Artificial Sequence
  Description of Artificial Sequence: Synthetic peptide
MTKPDPW

SEQ ID NO: 1857 - protein, 7 aa, Artificial Sequence
  Description of Artificial Sequence: Synthetic peptide
MTKPDKW

SEQ ID NO: 1858 - protein, 6 aa, Artificial Sequence
  Description of Artificial Sequence: Synthetic peptide
MTKPWW

SEQ ID NO: 1859 - protein, 7 aa, Artificial Sequence
  Description of Artificial Sequence: Synthetic peptide
MTKPWRW

SEQ ID NO: 1860 - protein, 7 aa, Artificial Sequence
  Description of Artificial Sequence: Synthetic peptide
MTKPWFW

SEQ ID NO: 1861 - protein, 7 aa, Artificial Sequence
  Description of Artificial Sequence: Synthetic peptide
MTKPWYW

SEQ ID NO: 1862 - protein, 7 aa, Artificial Sequence
  Description of Artificial Sequence: Synthetic peptide
MTKPWHW

SEQ ID NO: 1863 - protein, 7 aa, Artificial Sequence
  Description of Artificial Sequence: Synthetic peptide
MTKPWPW

SEQ ID NO: 1864 - protein, 7 aa, Artificial Sequence
  Description of Artificial Sequence: Synthetic peptide
MTKPWKW

SEQ ID NO: 1865 - protein, 6 aa, Artificial Sequence
  Description of Artificial Sequence: Synthetic peptide
MTKPQW

SEQ ID NO: 1866 - protein, 7 aa, Artificial Sequence
  Description of Artificial Sequence: Synthetic peptide
MTKPQRW

SEQ ID NO: 1867 - protein, 7 aa, Artificial Sequence
  Description of Artificial Sequence: Synthetic peptide
MTKPQFW

SEQ ID NO: 1868 - protein, 7 aa, Artificial Sequence
  Description of Artificial Sequence: Synthetic peptide
MTKPQYW

SEQ ID NO: 1869 - protein, 7 aa, Artificial Sequence
  Description of Artificial Sequence: Synthetic peptide
MTKPQHW

SEQ ID NO: 1870 - protein, 7 aa, Artificial Sequence
  Description of Artificial Sequence: Synthetic peptide
MTKPQPW

SEQ ID NO: 1871 - protein, 7 aa, Artificial Sequence
  Description of Artificial Sequence: Synthetic peptide
MTKPQKW

SEQ ID NO: 1872 - protein, 6 aa, Artificial Sequence
  Description of Artificial Sequence: Synthetic peptide
MTKPNW

SEQ ID NO: 1873 - protein, 7 aa, Artificial Sequence
  Description of Artificial Sequence: Synthetic peptide
MTKPNRW

SEQ ID NO: 1874 - protein, 7 aa, Artificial Sequence
  Description of Artificial Sequence: Synthetic peptide
MTKPNFW

SEQ ID NO: 1875 - protein, 7 aa, Artificial Sequence
  Description of Artificial Sequence: Synthetic peptide
MTKPNYW

SEQ ID NO: 1876 - protein, 7 aa, Artificial Sequence
  Description of Artificial Sequence: Synthetic peptide
MTKPNHW

SEQ ID NO: 1877 - protein, 7 aa, Artificial Sequence
  Description of Artificial Sequence: Synthetic peptide
MTKPNPW

SEQ ID NO: 1878 - protein, 7 aa, Artificial Sequence
  Description of Artificial Sequence: Synthetic peptide
MTKPNKW

SEQ ID NO: 1879 - protein, 6 aa, Artificial Sequence
  Description of Artificial Sequence: Synthetic peptide
MTKPYW

SEQ ID NO: 1880 - protein, 7 aa, Artificial Sequence
  Description of Artificial Sequence: Synthetic peptide
MTKPYRW

SEQ ID NO: 1881 - protein, 7 aa, Artificial Sequence
  Description of Artificial Sequence: Synthetic peptide
MTKPYFW

SEQ ID NO: 1882 - protein, 7 aa, Artificial Sequence
  Description of Artificial Sequence: Synthetic peptide
MTKPYYW

SEQ ID NO: 1883 - protein, 7 aa, Artificial Sequence
  Description of Artificial Sequence: Synthetic peptide
MTKPYHW

SEQ ID NO: 1884 - protein, 7 aa, Artificial Sequence
  Description of Artificial Sequence: Synthetic peptide
MTKPYPW

SEQ ID NO: 1885 - protein, 7 aa, Artificial Sequence
  Description of Artificial Sequence: Synthetic peptide
MTKPYKW

SEQ ID NO: 1886 - protein, 6 aa, Artificial Sequence
  Description of Artificial Sequence: Synthetic peptide
MTKPRW

SEQ ID NO: 1887 - protein, 7 aa, Artificial Sequence
  Description of Artificial Sequence: Synthetic peptide
MTKPRRW

SEQ ID NO: 1888 - protein, 7 aa, Artificial Sequence
  Description of Artificial Sequence: Synthetic peptide
MTKPRFW

SEQ ID NO: 1889 - protein, 7 aa, Artificial Sequence
  Description of Artificial Sequence: Synthetic peptide
MTKPRYW

SEQ ID NO: 1890 - protein, 7 aa, Artificial Sequence
  Description of Artificial Sequence: Synthetic peptide
MTKPRHW

SEQ ID NO: 1891 - protein, 7 aa, Artificial Sequence
  Description of Artificial Sequence: Synthetic peptide
MTKPRPW

SEQ ID NO: 1892 - protein, 7 aa, Artificial Sequence
  Description of Artificial Sequence: Synthetic peptide
MTKPRKW

SEQ ID NO: 1893 - protein, 5 aa, Artificial Sequence
  Description of Artificial Sequence: Synthetic peptide
MTKPW

SEQ ID NO: 1894 - protein, 6 aa, Artificial Sequence
  Description of Artificial Sequence: Synthetic peptide
MTKPRW

SEQ ID NO: 1895 - protein, 6 aa, Artificial Sequence
  Description of Artificial Sequence: Synthetic peptide
MTKPFW

SEQ ID NO: 1896 - protein, 6 aa, Artificial Sequence
  Description of Artificial Sequence: Synthetic peptide
MTKPYW

SEQ ID NO: 1897 - protein, 6 aa, Artificial Sequence
  Description of Artificial Sequence: Synthetic peptide
MTKPGW

SEQ ID NO: 1898 - protein, 6 aa, Artificial Sequence
  Description of Artificial Sequence: Synthetic peptide
MTKPHW

SEQ ID NO: 1899 - protein, 6 aa, Artificial Sequence
  Description of Artificial Sequence: Synthetic peptide
MTKPKW

SEQ ID NO: 1900 - protein, 6 aa, Artificial Sequence
  Description of Artificial Sequence: Synthetic peptide
MTKPGW

SEQ ID NO: 1901 - protein, 7 aa, Artificial Sequence
  Description of Artificial Sequence: Synthetic peptide
MTKPGRW

SEQ ID NO: 1902 - protein, 7 aa, Artificial Sequence
  Description of Artificial Sequence: Synthetic peptide
MTKPGFW

SEQ ID NO: 1903 - protein, 7 aa, Artificial Sequence
  Description of Artificial Sequence: Synthetic peptide
MTKPGYW

SEQ ID NO: 1904 - protein, 7 aa, Artificial Sequence
  Description of Artificial Sequence: Synthetic peptide
MTKPGHW

SEQ ID NO: 1905 - protein, 7 aa, Artificial Sequence
  Description of Artificial Sequence: Synthetic peptide
MTKPGPW

SEQ ID NO: 1906 - protein, 7 aa, Artificial Sequence
  Description of Artificial Sequence: Synthetic peptide
MTKPGKW

SEQ ID NO: 1907 - protein, 6 aa, Artificial Sequence
  Description of Artificial Sequence: Synthetic peptide
MTKPDW

SEQ ID NO: 1908 - protein, 7 aa, Artificial Sequence
  Description of Artificial Sequence: Synthetic peptide
MTKPDRW

SEQ ID NO: 1909 - protein, 7 aa, Artificial Sequence
  Description of Artificial Sequence: Synthetic peptide
MTKPDFW

SEQ ID NO: 1910 - protein, 7 aa, Artificial Sequence
  Description of Artificial Sequence: Synthetic peptide
MTKPDYW

SEQ ID NO: 1911 - protein, 7 aa, Artificial Sequence
  Description of Artificial Sequence: Synthetic peptide
MTKPDHW

SEQ ID NO: 1912 - protein, 7 aa, Artificial Sequence
  Description of Artificial Sequence: Synthetic peptide
MTKPDPW

SEQ ID NO: 1913 - protein, 7 aa, Artificial Sequence
  Description of Artificial Sequence: Synthetic peptide
MTKPDKW

SEQ ID NO: 1914 - protein, 6 aa, Artificial Sequence
  Description of Artificial Sequence: Synthetic peptide
MTKPWW

SEQ ID NO: 1915 - protein, 7 aa, Artificial Sequence
  Description of Artificial Sequence: Synthetic peptide
MTKPWRW

SEQ ID NO: 1916 - protein, 7 aa, Artificial Sequence
  Description of Artificial Sequence: Synthetic peptide
MTKPWFW

SEQ ID NO: 1917 - protein, 7 aa, Artificial Sequence
  Description of Artificial Sequence: Synthetic peptide
MTKPWYW

SEQ ID NO: 1918 - protein, 7 aa, Artificial Sequence
  Description of Artificial Sequence: Synthetic peptide
MTKPWHW

SEQ ID NO: 1919 - protein, 7 aa, Artificial Sequence
  Description of Artificial Sequence: Synthetic peptide
MTKPWPW

SEQ ID NO: 1920 - protein, 7 aa, Artificial Sequence
  Description of Artificial Sequence: Synthetic peptide
MTKPWKW

SEQ ID NO: 1921 - protein, 6 aa, Artificial Sequence
  Description of Artificial Sequence: Synthetic peptide
MTKPQW

SEQ ID NO: 1922 - protein, 7 aa, Artificial Sequence
  Description of Artificial Sequence: Synthetic peptide
MTKPQRW

SEQ ID NO: 1923 - protein, 7 aa, Artificial Sequence
  Description of Artificial Sequence: Synthetic peptide
MTKPQFW

SEQ ID NO: 1924 - protein, 7 aa, Artificial Sequence
  Description of Artificial Sequence: Synthetic peptide
MTKPQYW

SEQ ID NO: 1925 - protein, 7 aa, Artificial Sequence
  Description of Artificial Sequence: Synthetic peptide
MTKPQHW

SEQ ID NO: 1926 - protein, 7 aa, Artificial Sequence
  Description of Artificial Sequence: Synthetic peptide
MTKPQPW

SEQ ID NO: 1927 - protein, 7 aa, Artificial Sequence
  Description of Artificial Sequence: Synthetic peptide
MTKPQKW

SEQ ID NO: 1928 - protein, 6 aa, Artificial Sequence
  Description of Artificial Sequence: Synthetic peptide
MTKPNW

SEQ ID NO: 1929 - protein, 7 aa, Artificial Sequence
  Description of Artificial Sequence: Synthetic peptide
MTKPNRW

SEQ ID NO: 1930 - protein, 7 aa, Artificial Sequence
  Description of Artificial Sequence: Synthetic peptide
MTKPNFW

SEQ ID NO: 1931 - protein, 7 aa, Artificial Sequence
  Description of Artificial Sequence: Synthetic peptide
MTKPNYW

SEQ ID NO: 1932 - protein, 7 aa, Artificial Sequence
  Description of Artificial Sequence: Synthetic peptide
MTKPNHW

SEQ ID NO: 1933 - protein, 7 aa, Artificial Sequence
  Description of Artificial Sequence: Synthetic peptide
MTKPNPW

SEQ ID NO: 1934 - protein, 7 aa, Artificial Sequence
  Description of Artificial Sequence: Synthetic peptide
MTKPNKW

SEQ ID NO: 1935 - protein, 6 aa, Artificial Sequence
  Description of Artificial Sequence: Synthetic peptide
MTKPYW

SEQ ID NO: 1936 - protein, 7 aa, Artificial Sequence
  Description of Artificial Sequence: Synthetic peptide
MTKPYRW

SEQ ID NO: 1937 - protein, 7 aa, Artificial Sequence
  Description of Artificial Sequence: Synthetic peptide
MTKPYFW

SEQ ID NO: 1938 - protein, 7 aa, Artificial Sequence
  Description of Artificial Sequence: Synthetic peptide
MTKPYYW

SEQ ID NO: 1939 - protein, 7 aa, Artificial Sequence
  Description of Artificial Sequence: Synthetic peptide
MTKPYHW

SEQ ID NO: 1940 - protein, 7 aa, Artificial Sequence
  Description of Artificial Sequence: Synthetic peptide
MTKPYPW

SEQ ID NO: 1941 - protein, 7 aa, Artificial Sequence
  Description of Artificial Sequence: Synthetic peptide
MTKPYKW

SEQ ID NO: 1942 - protein, 6 aa, Artificial Sequence
  Description of Artificial Sequence: Synthetic peptide
MTKPRW

SEQ ID NO: 1943 - protein, 7 aa, Artificial Sequence
  Description of Artificial Sequence: Synthetic peptide
MTKPRRW

SEQ ID NO: 1944 - protein, 7 aa, Artificial Sequence
  Description of Artificial Sequence: Synthetic peptide
MTKPRFW

SEQ ID NO: 1945 - protein, 7 aa, Artificial Sequence
  Description of Artificial Sequence: Synthetic peptide
MTKPRYW

SEQ ID NO: 1946 - protein, 7 aa, Artificial Sequence
  Description of Artificial Sequence: Synthetic peptide
MTKPRHW

SEQ ID NO: 1947 - protein, 7 aa, Artificial Sequence
  Description of Artificial Sequence: Synthetic peptide
MTKPRPW

SEQ ID NO: 1948 - protein, 7 aa, Artificial Sequence
  Description of Artificial Sequence: Synthetic peptide
MTKPRKW

SEQ ID NO: 1949 - protein, 5 aa, Artificial Sequence
  Description of Artificial Sequence: Synthetic peptide
TTKPW

SEQ ID NO: 1950 - protein, 6 aa, Artificial Sequence
  Description of Artificial Sequence: Synthetic peptide
TTKPRW

SEQ ID NO: 1951 - protein, 6 aa, Artificial Sequence
  Description of Artificial Sequence: Synthetic peptide
TTKPFW

SEQ ID NO: 1952 - protein, 6 aa, Artificial Sequence
  Description of Artificial Sequence: Synthetic peptide
TTKPYW

SEQ ID NO: 1953 - protein, 6 aa, Artificial Sequence
  Description of Artificial Sequence: Synthetic peptide
TTKPGW

SEQ ID NO: 1954 - protein, 6 aa, Artificial Sequence
  Description of Artificial Sequence: Synthetic peptide
TTKPHW

SEQ ID NO: 1955 - protein, 6 aa, Artificial Sequence
  Description of Artificial Sequence: Synthetic peptide
TTKPKW

SEQ ID NO: 1956 - protein, 6 aa, Artificial Sequence
  Description of Artificial Sequence: Synthetic peptide
TTKPGW

SEQ ID NO: 1957 - protein, 7 aa, Artificial Sequence
  Description of Artificial Sequence: Synthetic peptide
TTKPGRW

SEQ ID NO: 1958 - protein, 7 aa, Artificial Sequence
  Description of Artificial Sequence: Synthetic peptide
TTKPGFW

SEQ ID NO: 1959 - protein, 7 aa, Artificial Sequence
  Description of Artificial Sequence: Synthetic peptide
TTKPGYW

SEQ ID NO: 1960 - protein, 7 aa, Artificial Sequence
  Description of Artificial Sequence: Synthetic peptide
TTKPGHW

SEQ ID NO: 1961 - protein, 7 aa, Artificial Sequence
  Description of Artificial Sequence: Synthetic peptide
TTKPGPW

SEQ ID NO: 1962 - protein, 7 aa, Artificial Sequence
  Description of Artificial Sequence: Synthetic peptide
TTKPGKW

SEQ ID NO: 1963 - protein, 6 aa, Artificial Sequence
  Description of Artificial Sequence: Synthetic peptide
TTKPDW

SEQ ID NO: 1964 - protein, 7 aa, Artificial Sequence
  Description of Artificial Sequence: Synthetic peptide
TTKPDRW

SEQ ID NO: 1965 - protein, 7 aa, Artificial Sequence
  Description of Artificial Sequence: Synthetic peptide
TTKPDFW

SEQ ID NO: 1966 - protein, 7 aa, Artificial Sequence
  Description of Artificial Sequence: Synthetic peptide
TTKPDYW

SEQ ID NO: 1967 - protein, 7 aa, Artificial Sequence
  Description of Artificial Sequence: Synthetic peptide
TTKPDHW

SEQ ID NO: 1968 - protein, 7 aa, Artificial Sequence
  Description of Artificial Sequence: Synthetic peptide
TTKPDPW

SEQ ID NO: 1969 - protein, 7 aa, Artificial Sequence
  Description of Artificial Sequence: Synthetic peptide
TTKPDKW

SEQ ID NO: 1970 - protein, 6 aa, Artificial Sequence
  Description of Artificial Sequence: Synthetic peptide
TTKPWW

SEQ ID NO: 1971 - protein, 7 aa, Artificial Sequence
  Description of Artificial Sequence: Synthetic peptide
TTKPWRW

SEQ ID NO: 1972 - protein, 7 aa, Artificial Sequence
  Description of Artificial Sequence: Synthetic peptide
TTKPWFW

SEQ ID NO: 1973 - protein, 7 aa, Artificial Sequence
  Description of Artificial Sequence: Synthetic peptide
TTKPWYW

SEQ ID NO: 1974 - protein, 7 aa, Artificial Sequence
  Description of Artificial Sequence: Synthetic peptide
TTKPWHW

SEQ ID NO: 1975 - protein, 7 aa, Artificial Sequence
  Description of Artificial Sequence: Synthetic peptide
TTKPWPW

SEQ ID NO: 1976 - protein, 7 aa, Artificial Sequence
  Description of Artificial Sequence: Synthetic peptide
TTKPWKW

SEQ ID NO: 1977 - protein, 6 aa, Artificial Sequence
  Description of Artificial Sequence: Synthetic peptide
TTKPQW

SEQ ID NO: 1978 - protein, 7 aa, Artificial Sequence
  Description of Artificial Sequence: Synthetic peptide
TTKPQRW

SEQ ID NO: 1979 - protein, 7 aa, Artificial Sequence
  Description of Artificial Sequence: Synthetic peptide
TTKPQFW

SEQ ID NO: 1980 - protein, 7 aa, Artificial Sequence
  Description of Artificial Sequence: Synthetic peptide
TTKPQYW

SEQ ID NO: 1981 - protein, 7 aa, Artificial Sequence
  Description of Artificial Sequence: Synthetic peptide
TTKPQHW

SEQ ID NO: 1982 - protein, 7 aa, Artificial Sequence
  Description of Artificial Sequence: Synthetic peptide
TTKPQPW

SEQ ID NO: 1983 - protein, 7 aa, Artificial Sequence
  Description of Artificial Sequence: Synthetic peptide
TTKPQKW

SEQ ID NO: 1984 - protein, 6 aa, Artificial Sequence
  Description of Artificial Sequence: Synthetic peptide
TTKPNW

SEQ ID NO: 1985 - protein, 7 aa, Artificial Sequence
  Description of Artificial Sequence: Synthetic peptide
TTKPNRW

SEQ ID NO: 1986 - protein, 7 aa, Artificial Sequence
  Description of Artificial Sequence: Synthetic peptide
TTKPNFW

SEQ ID NO: 1987 - protein, 7 aa, Artificial Sequence
  Description of Artificial Sequence: Synthetic peptide
TTKPNYW

SEQ ID NO: 1988 - protein, 7 aa, Artificial Sequence
  Description of Artificial Sequence: Synthetic peptide
TTKPNHW

SEQ ID NO: 1989 - protein, 7 aa, Artificial Sequence
  Description of Artificial Sequence: Synthetic peptide
TTKPNPW

SEQ ID NO: 1990 - protein, 7 aa, Artificial Sequence
  Description of Artificial Sequence: Synthetic peptide
TTKPNKW

SEQ ID NO: 1991 - protein, 6 aa, Artificial Sequence
  Description of Artificial Sequence: Synthetic peptide
TTKPYW

SEQ ID NO: 1992 - protein, 7 aa, Artificial Sequence
  Description of Artificial Sequence: Synthetic peptide
TTKPYRW

SEQ ID NO: 1993 - protein, 7 aa, Artificial Sequence
  Description of Artificial Sequence: Synthetic peptide
TTKPYFW

SEQ ID NO: 1994 - protein, 7 aa, Artificial Sequence
  Description of Artificial Sequence: Synthetic peptide
TTKPYYW

SEQ ID NO: 1995 - protein, 7 aa, Artificial Sequence
  Description of Artificial Sequence: Synthetic peptide
TTKPYHW

SEQ ID NO: 1996 - protein, 7 aa, Artificial Sequence
  Description of Artificial Sequence: Synthetic peptide
TTKPYPW

SEQ ID NO: 1997 - protein, 7 aa, Artificial Sequence
  Description of Artificial Sequence: Synthetic peptide
TTKPYKW

SEQ ID NO: 1998 - protein, 6 aa, Artificial Sequence
  Description of Artificial Sequence: Synthetic peptide
TTKPRW

SEQ ID NO: 1999 - protein, 7 aa, Artificial Sequence
  Description of Artificial Sequence: Synthetic peptide
TTKPRRW

SEQ ID NO: 2000 - protein, 7 aa, Artificial Sequence
  Description of Artificial Sequence: Synthetic peptide
TTKPRFW

SEQ ID NO: 2001 - protein, 7 aa, Artificial Sequence
  Description of Artificial Sequence: Synthetic peptide
TTKPRYW

SEQ ID NO: 2002 - protein, 7 aa, Artificial Sequence
  Description of Artificial Sequence: Synthetic peptide
TTKPRHW

SEQ ID NO: 2003 - protein, 7 aa, Artificial Sequence
  Description of Artificial Sequence: Synthetic peptide
TTKPRPW

SEQ ID NO: 2004 - protein, 7 aa, Artificial Sequence
  Description of Artificial Sequence: Synthetic peptide
TTKPRKW

SEQ ID NO: 2005 - protein, 5 aa, Artificial Sequence
  Description of Artificial Sequence: Synthetic peptide
ATKPW

SEQ ID NO: 2006 - protein, 6 aa, Artificial Sequence
  Description of Artificial Sequence: Synthetic peptide
ATKPRW

SEQ ID NO: 2007 - protein, 6 aa, Artificial Sequence
  Description of Artificial Sequence: Synthetic peptide
ATKPFW

SEQ ID NO: 2008 - protein, 6 aa, Artificial Sequence
  Description of Artificial Sequence: Synthetic peptide
ATKPYW

SEQ ID NO: 2009 - protein, 6 aa, Artificial Sequence
  Description of Artificial Sequence: Synthetic peptide
ATKPGW

SEQ ID NO: 2010 - protein, 6 aa, Artificial Sequence
  Description of Artificial Sequence: Synthetic peptide
ATKPHW

SEQ ID NO: 2011 - protein, 6 aa, Artificial Sequence
  Description of Artificial Sequence: Synthetic peptide
ATKPKW

SEQ ID NO: 2012 - protein, 6 aa, Artificial Sequence
  Description of Artificial Sequence: Synthetic peptide
ATKPGW

SEQ ID NO: 2013 - protein, 7 aa, Artificial Sequence
  Description of Artificial Sequence: Synthetic peptide
ATKPGRW

SEQ ID NO: 2014 - protein, 7 aa, Artificial Sequence
  Description of Artificial Sequence: Synthetic peptide
ATKPGFW

SEQ ID NO: 2015 - protein, 7 aa, Artificial Sequence
  Description of Artificial Sequence: Synthetic peptide
ATKPGYW

SEQ ID NO: 2016 - protein, 7 aa, Artificial Sequence
  Description of Artificial Sequence: Synthetic peptide
ATKPGHW

SEQ ID NO: 2017 - protein, 7 aa, Artificial Sequence
  Description of Artificial Sequence: Synthetic peptide
ATKPGPW

SEQ ID NO: 2018 - protein, 7 aa, Artificial Sequence
  Description of Artificial Sequence: Synthetic peptide
ATKPGKW

SEQ ID NO: 2019 - protein, 6 aa, Artificial Sequence
  Description of Artificial Sequence: Synthetic peptide
ATKPDW

SEQ ID NO: 2020 - protein, 7 aa, Artificial Sequence
  Description of Artificial Sequence: Synthetic peptide
ATKPDRW

SEQ ID NO: 2021 - protein, 7 aa, Artificial Sequence
  Description of Artificial Sequence: Synthetic peptide
ATKPDFW

SEQ ID NO: 2022 - protein, 7 aa, Artificial Sequence
  Description of Artificial Sequence: Synthetic peptide
ATKPDYW

SEQ ID NO: 2023 - protein, 7 aa, Artificial Sequence
  Description of Artificial Sequence: Synthetic peptide
ATKPDHW

SEQ ID NO: 2024 - protein, 7 aa, Artificial Sequence
  Description of Artificial Sequence: Synthetic peptide
ATKPDPW

SEQ ID NO: 2025 - protein, 7 aa, Artificial Sequence
  Description of Artificial Sequence: Synthetic peptide
ATKPDKW

SEQ ID NO: 2026 - protein, 6 aa, Artificial Sequence
  Description of Artificial Sequence: Synthetic peptide
ATKPWW

SEQ ID NO: 2027 - protein, 7 aa, Artificial Sequence
  Description of Artificial Sequence: Synthetic peptide
ATKPWRW

SEQ ID NO: 2028 - protein, 7 aa, Artificial Sequence
  Description of Artificial Sequence: Synthetic peptide
ATKPWFW

SEQ ID NO: 2029 - protein, 7 aa, Artificial Sequence
  Description of Artificial Sequence: Synthetic peptide
ATKPWYW

SEQ ID NO: 2030 - protein, 7 aa, Artificial Sequence
  Description of Artificial Sequence: Synthetic peptide
ATKPWHW

SEQ ID NO: 2031 - protein, 7 aa, Artificial Sequence
  Description of Artificial Sequence: Synthetic peptide
ATKPWPW

SEQ ID NO: 2032 - protein, 7 aa, Artificial Sequence
  Description of Artificial Sequence: Synthetic peptide
ATKPWKW

SEQ ID NO: 2033 - protein, 6 aa, Artificial Sequence
  Description of Artificial Sequence: Synthetic peptide
ATKPQW

SEQ ID NO: 2034 - protein, 7 aa, Artificial Sequence
  Description of Artificial Sequence: Synthetic peptide
ATKPQRW

SEQ ID NO: 2035 - protein, 7 aa, Artificial Sequence
  Description of Artificial Sequence: Synthetic peptide
ATKPQFW

SEQ ID NO: 2036 - protein, 7 aa, Artificial Sequence
  Description of Artificial Sequence: Synthetic peptide
ATKPQYW

SEQ ID NO: 2037 - protein, 7 aa, Artificial Sequence
  Description of Artificial Sequence: Synthetic peptide
ATKPQHW

SEQ ID NO: 2038 - protein, 7 aa, Artificial Sequence
  Description of Artificial Sequence: Synthetic peptide
ATKPQPW

SEQ ID NO: 2039 - protein, 7 aa, Artificial Sequence
  Description of Artificial Sequence: Synthetic peptide
ATKPQKW

SEQ ID NO: 2040 - protein, 6 aa, Artificial Sequence
  Description of Artificial Sequence: Synthetic peptide
ATKPNW

SEQ ID NO: 2041 - protein, 7 aa, Artificial Sequence
  Description of Artificial Sequence: Synthetic peptide
ATKPNRW

SEQ ID NO: 2042 - protein, 7 aa, Artificial Sequence
  Description of Artificial Sequence: Synthetic peptide
ATKPNFW

SEQ ID NO: 2043 - protein, 7 aa, Artificial Sequence
  Description of Artificial Sequence: Synthetic peptide
ATKPNYW

SEQ ID NO: 2044 - protein, 7 aa, Artificial Sequence
  Description of Artificial Sequence: Synthetic peptide
ATKPNHW

SEQ ID NO: 2045 - protein, 7 aa, Artificial Sequence
  Description of Artificial Sequence: Synthetic peptide
ATKPNPW

SEQ ID NO: 2046 - protein, 7 aa, Artificial Sequence
  Description of Artificial Sequence: Synthetic peptide
ATKPNKW

SEQ ID NO: 2047 - protein, 6 aa, Artificial Sequence
  Description of Artificial Sequence: Synthetic peptide
ATKPYW

SEQ ID NO: 2048 - protein, 7 aa, Artificial Sequence
  Description of Artificial Sequence: Synthetic peptide
ATKPYRW

SEQ ID NO: 2049 - protein, 7 aa, Artificial Sequence
  Description of Artificial Sequence: Synthetic peptide
ATKPYFW

SEQ ID NO: 2050 - protein, 7 aa, Artificial Sequence
  Description of Artificial Sequence: Synthetic peptide
ATKPYYW

SEQ ID NO: 2051 - protein, 7 aa, Artificial Sequence
  Description of Artificial Sequence: Synthetic peptide
ATKPYHW

SEQ ID NO: 2052 - protein, 7 aa, Artificial Sequence
  Description of Artificial Sequence: Synthetic peptide
ATKPYPW

SEQ ID NO: 2053 - protein, 7 aa, Artificial Sequence
  Description of Artificial Sequence: Synthetic peptide
ATKPYKW

SEQ ID NO: 2054 - protein, 6 aa, Artificial Sequence
  Description of Artificial Sequence: Synthetic peptide
ATKPRW

SEQ ID NO: 2055 - protein, 7 aa, Artificial Sequence
  Description of Artificial Sequence: Synthetic peptide
ATKPRRW

SEQ ID NO: 2056 - protein, 7 aa, Artificial Sequence
  Description of Artificial Sequence: Synthetic peptide
ATKPRFW

SEQ ID NO: 2057 - protein, 7 aa, Artificial Sequence
  Description of Artificial Sequence: Synthetic peptide
ATKPRYW

SEQ ID NO: 2058 - protein, 7 aa, Artificial Sequence
  Description of Artificial Sequence: Synthetic peptide
ATKPRHW

SEQ ID NO: 2059 - protein, 7 aa, Artificial Sequence
  Description of Artificial Sequence: Synthetic peptide
ATKPRPW

SEQ ID NO: 2060 - protein, 7 aa, Artificial Sequence
  Description of Artificial Sequence: Synthetic peptide
ATKPRKW

SEQ ID NO: 2061 - protein, 5 aa, Artificial Sequence
  Description of Artificial Sequence: Synthetic peptide
HTKPW

SEQ ID NO: 2062 - protein, 6 aa, Artificial Sequence
  Description of Artificial Sequence: Synthetic peptide
HTKPRW

SEQ ID NO: 2063 - protein, 6 aa, Artificial Sequence
  Description of Artificial Sequence: Synthetic peptide
HTKPFW

SEQ ID NO: 2064 - protein, 6 aa, Artificial Sequence
  Description of Artificial Sequence: Synthetic peptide
HTKPYW

SEQ ID NO: 2065 - protein, 6 aa, Artificial Sequence
  Description of Artificial Sequence: Synthetic peptide
HTKPGW

SEQ ID NO: 2066 - protein, 6 aa, Artificial Sequence
  Description of Artificial Sequence: Synthetic peptide
HTKPHW

SEQ ID NO: 2067 - protein, 6 aa, Artificial Sequence
  Description of Artificial Sequence: Synthetic peptide
HTKPKW

SEQ ID NO: 2068 - protein, 6 aa, Artificial Sequence
  Description of Artificial Sequence: Synthetic peptide
HTKPGW

SEQ ID NO: 2069 - protein, 7 aa, Artificial Sequence
  Description of Artificial Sequence: Synthetic peptide
HTKPGRW

SEQ ID NO: 2070 - protein, 7 aa, Artificial Sequence
  Description of Artificial Sequence: Synthetic peptide
HTKPGFW

SEQ ID NO: 2071 - protein, 7 aa, Artificial Sequence
  Description of Artificial Sequence: Synthetic peptide
HTKPGYW

SEQ ID NO: 2072 - protein, 7 aa, Artificial Sequence
  Description of Artificial Sequence: Synthetic peptide
HTKPGHW

SEQ ID NO: 2073 - protein, 7 aa, Artificial Sequence
  Description of Artificial Sequence: Synthetic peptide
HTKPGPW

SEQ ID NO: 2074 - protein, 7 aa, Artificial Sequence
  Description of Artificial Sequence: Synthetic peptide
HTKPGKW

SEQ ID NO: 2075 - protein, 6 aa, Artificial Sequence
  Description of Artificial Sequence: Synthetic peptide
HTKPDW

SEQ ID NO: 2076 - protein, 7 aa, Artificial Sequence
  Description of Artificial Sequence: Synthetic peptide
HTKPDRW

SEQ ID NO: 2077 - protein, 7 aa, Artificial Sequence
  Description of Artificial Sequence: Synthetic peptide
HTKPDFW

SEQ ID NO: 2078 - protein, 7 aa, Artificial Sequence
  Description of Artificial Sequence: Synthetic peptide
HTKPDYW

SEQ ID NO: 2079 - protein, 7 aa, Artificial Sequence
  Description of Artificial Sequence: Synthetic peptide
HTKPDHW

SEQ ID NO: 2080 - protein, 7 aa, Artificial Sequence
  Description of Artificial Sequence: Synthetic peptide
HTKPDPW

SEQ ID NO: 2081 - protein, 7 aa, Artificial Sequence
  Description of Artificial Sequence: Synthetic peptide
HTKPDKW

SEQ ID NO: 2082 - protein, 6 aa, Artificial Sequence
  Description of Artificial Sequence: Synthetic peptide
HTKPWW

SEQ ID NO: 2083 - protein, 7 aa, Artificial Sequence
  Description of Artificial Sequence: Synthetic peptide
HTKPWRW

SEQ ID NO: 2084 - protein, 7 aa, Artificial Sequence
  Description of Artificial Sequence: Synthetic peptide
HTKPWFW

SEQ ID NO: 2085 - protein, 7 aa, Artificial Sequence
  Description of Artificial Sequence: Synthetic peptide
HTKPWYW

SEQ ID NO: 2086 - protein, 7 aa, Artificial Sequence
  Description of Artificial Sequence: Synthetic peptide
HTKPWHW

SEQ ID NO: 2087 - protein, 7 aa, Artificial Sequence
  Description of Artificial Sequence: Synthetic peptide
HTKPWPW

SEQ ID NO: 2088 - protein, 7 aa, Artificial Sequence
  Description of Artificial Sequence: Synthetic peptide
HTKPWKW

SEQ ID NO: 2089 - protein, 6 aa, Artificial Sequence
  Description of Artificial Sequence: Synthetic peptide
HTKPQW

SEQ ID NO: 2090 - protein, 7 aa, Artificial Sequence
  Description of Artificial Sequence: Synthetic peptide
HTKPQRW

SEQ ID NO: 2091 - protein, 7 aa, Artificial Sequence
  Description of Artificial Sequence: Synthetic peptide
HTKPQFW

SEQ ID NO: 2092 - protein, 7 aa, Artificial Sequence
  Description of Artificial Sequence: Synthetic peptide
HTKPQYW

SEQ ID NO: 2093 - protein, 7 aa, Artificial Sequence
  Description of Artificial Sequence: Synthetic peptide
HTKPQHW

SEQ ID NO: 2094 - protein, 7 aa, Artificial Sequence
  Description of Artificial Sequence: Synthetic peptide
HTKPQPW

SEQ ID NO: 2095 - protein, 7 aa, Artificial Sequence
  Description of Artificial Sequence: Synthetic peptide
HTKPQKW

SEQ ID NO: 2096 - protein, 6 aa, Artificial Sequence
  Description of Artificial Sequence: Synthetic peptide
HTKPNW

SEQ ID NO: 2097 - protein, 7 aa, Artificial Sequence
  Description of Artificial Sequence: Synthetic peptide
HTKPNRW

SEQ ID NO: 2098 - protein, 7 aa, Artificial Sequence
  Description of Artificial Sequence: Synthetic peptide
HTKPNFW

SEQ ID NO: 2099 - protein, 7 aa, Artificial Sequence
  Description of Artificial Sequence: Synthetic peptide
HTKPNYW

SEQ ID NO: 2100 - protein, 7 aa, Artificial Sequence
  Description of Artificial Sequence: Synthetic peptide
HTKPNHW

SEQ ID NO: 2101 - protein, 7 aa, Artificial Sequence
  Description of Artificial Sequence: Synthetic peptide
HTKPNPW

SEQ ID NO: 2102 - protein, 7 aa, Artificial Sequence
  Description of Artificial Sequence: Synthetic peptide
HTKPNKW

SEQ ID NO: 2103 - protein, 6 aa, Artificial Sequence
  Description of Artificial Sequence: Synthetic peptide
HTKPYW

SEQ ID NO: 2104 - protein, 7 aa, Artificial Sequence
  Description of Artificial Sequence: Synthetic peptide
HTKPYRW

SEQ ID NO: 2105 - protein, 7 aa, Artificial Sequence
  Description of Artificial Sequence: Synthetic peptide
HTKPYFW

SEQ ID NO: 2106 - protein, 7 aa, Artificial Sequence
  Description of Artificial Sequence: Synthetic peptide
HTKPYYW

SEQ ID NO: 2107 - protein, 7 aa, Artificial Sequence
  Description of Artificial Sequence: Synthetic peptide
HTKPYHW

SEQ ID NO: 2108 - protein, 7 aa, Artificial Sequence
  Description of Artificial Sequence: Synthetic peptide
HTKPYPW

SEQ ID NO: 2109 - protein, 7 aa, Artificial Sequence
  Description of Artificial Sequence: Synthetic peptide
HTKPYKW

SEQ ID NO: 2110 - protein, 6 aa, Artificial Sequence
  Description of Artificial Sequence: Synthetic peptide
HTKPRW

SEQ ID NO: 2111 - protein, 7 aa, Artificial Sequence
  Description of Artificial Sequence: Synthetic peptide
HTKPRRW

SEQ ID NO: 2112 - protein, 7 aa, Artificial Sequence
  Description of Artificial Sequence: Synthetic peptide
HTKPRFW

SEQ ID NO: 2113 - protein, 7 aa, Artificial Sequence
  Description of Artificial Sequence: Synthetic peptide
HTKPRYW

SEQ ID NO: 2114 - protein, 7 aa, Artificial Sequence
  Description of Artificial Sequence: Synthetic peptide
HTKPRHW

SEQ ID NO: 2115 - protein, 7 aa, Artificial Sequence
  Description of Artificial Sequence: Synthetic peptide
HTKPRPW

SEQ ID NO: 2116 - protein, 7 aa, Artificial Sequence
  Description of Artificial Sequence: Synthetic peptide
HTKPRKW

SEQ ID NO: 2117 - protein, 5 aa, Artificial Sequence
  Description of Artificial Sequence: Synthetic peptide
KTKPW

SEQ ID NO: 2118 - protein, 6 aa, Artificial Sequence
  Description of Artificial Sequence: Synthetic peptide
KTKPRW

SEQ ID NO: 2119 - protein, 6 aa, Artificial Sequence
  Description of Artificial Sequence: Synthetic peptide
KTKPFW

SEQ ID NO: 2120 - protein, 6 aa, Artificial Sequence
  Description of Artificial Sequence: Synthetic peptide
KTKPYW

SEQ ID NO: 2121 - protein, 6 aa, Artificial Sequence
  Description of Artificial Sequence: Synthetic peptide
KTKPGW

SEQ ID NO: 2122 - protein, 6 aa, Artificial Sequence
  Description of Artificial Sequence: Synthetic peptide
KTKPHW

SEQ ID NO: 2123 - protein, 6 aa, Artificial Sequence
  Description of Artificial Sequence: Synthetic peptide
KTKPKW

SEQ ID NO: 2124 - protein, 6 aa, Artificial Sequence
  Description of Artificial Sequence: Synthetic peptide
KTKPGW

SEQ ID NO: 2125 - protein, 7 aa, Artificial Sequence
  Description of Artificial Sequence: Synthetic peptide
KTKPGRW

SEQ ID NO: 2126 - protein, 7 aa, Artificial Sequence
  Description of Artificial Sequence: Synthetic peptide
KTKPGFW

SEQ ID NO: 2127 - protein, 7 aa, Artificial Sequence
  Description of Artificial Sequence: Synthetic peptide
KTKPGYW

SEQ ID NO: 2128 - protein, 7 aa, Artificial Sequence
  Description of Artificial Sequence: Synthetic peptide
KTKPGHW

SEQ ID NO: 2129 - protein, 7 aa, Artificial Sequence
  Description of Artificial Sequence: Synthetic peptide
KTKPGPW

SEQ ID NO: 2130 - protein, 7 aa, Artificial Sequence
  Description of Artificial Sequence: Synthetic peptide
KTKPGKW

SEQ ID NO: 2131 - protein, 6 aa, Artificial Sequence
  Description of Artificial Sequence: Synthetic peptide
KTKPDW

SEQ ID NO: 2132 - protein, 7 aa, Artificial Sequence
  Description of Artificial Sequence: Synthetic peptide
KTKPDRW

SEQ ID NO: 2133 - protein, 7 aa, Artificial Sequence
  Description of Artificial Sequence: Synthetic peptide
KTKPDFW

SEQ ID NO: 2134 - protein, 7 aa, Artificial Sequence
  Description of Artificial Sequence: Synthetic peptide
KTKPDYW

SEQ ID NO: 2135 - protein, 7 aa, Artificial Sequence
  Description of Artificial Sequence: Synthetic peptide
KTKPDHW

SEQ ID NO: 2136 - protein, 7 aa, Artificial Sequence
  Description of Artificial Sequence: Synthetic peptide
KTKPDPW

SEQ ID NO: 2137 - protein, 7 aa, Artificial Sequence
  Description of Artificial Sequence: Synthetic peptide
KTKPDKW

SEQ ID NO: 2138 - protein, 6 aa, Artificial Sequence
  Description of Artificial Sequence: Synthetic peptide
KTKPWW

SEQ ID NO: 2139 - protein, 7 aa, Artificial Sequence
  Description of Artificial Sequence: Synthetic peptide
KTKPWRW

SEQ ID NO: 2140 - protein, 7 aa, Artificial Sequence
  Description of Artificial Sequence: Synthetic peptide
KTKPWFW

SEQ ID NO: 2141 - protein, 7 aa, Artificial Sequence
  Description of Artificial Sequence: Synthetic peptide
KTKPWYW

SEQ ID NO: 2142 - protein, 7 aa, Artificial Sequence
  Description of Artificial Sequence: Synthetic peptide
KTKPWHW

SEQ ID NO: 2143 - protein, 7 aa, Artificial Sequence
  Description of Artificial Sequence: Synthetic peptide
KTKPWPW

SEQ ID NO: 2144 - protein, 7 aa, Artificial Sequence
  Description of Artificial Sequence: Synthetic peptide
KTKPWKW

SEQ ID NO: 2145 - protein, 6 aa, Artificial Sequence
  Description of Artificial Sequence: Synthetic peptide
KTKPQW

SEQ ID NO: 2146 - protein, 7 aa, Artificial Sequence
  Description of Artificial Sequence: Synthetic peptide
KTKPQRW

SEQ ID NO: 2147 - protein, 7 aa, Artificial Sequence
  Description of Artificial Sequence: Synthetic peptide
KTKPQFW

SEQ ID NO: 2148 - protein, 7 aa, Artificial Sequence
  Description of Artificial Sequence: Synthetic peptide
KTKPQYW

SEQ ID NO: 2149 - protein, 7 aa, Artificial Sequence
  Description of Artificial Sequence: Synthetic peptide
KTKPQHW

SEQ ID NO: 2150 - protein, 7 aa, Artificial Sequence
  Description of Artificial Sequence: Synthetic peptide
KTKPQPW

SEQ ID NO: 2151 - protein, 7 aa, Artificial Sequence
  Description of Artificial Sequence: Synthetic peptide
KTKPQKW

SEQ ID NO: 2152 - protein, 6 aa, Artificial Sequence
  Description of Artificial Sequence: Synthetic peptide
KTKPNW

SEQ ID NO: 2153 - protein, 7 aa, Artificial Sequence
  Description of Artificial Sequence: Synthetic peptide
KTKPNRW

SEQ ID NO: 2154 - protein, 7 aa, Artificial Sequence
  Description of Artificial Sequence: Synthetic peptide
KTKPNFW

SEQ ID NO: 2155 - protein, 7 aa, Artificial Sequence
  Description of Artificial Sequence: Synthetic peptide
KTKPNYW

SEQ ID NO: 2156 - protein, 7 aa, Artificial Sequence
  Description of Artificial Sequence: Synthetic peptide
KTKPNHW

SEQ ID NO: 2157 - protein, 7 aa, Artificial Sequence
  Description of Artificial Sequence: Synthetic peptide
KTKPNPW

SEQ ID NO: 2158 - protein, 7 aa, Artificial Sequence
  Description of Artificial Sequence: Synthetic peptide
KTKPNKW

SEQ ID NO: 2159 - protein, 6 aa, Artificial Sequence
  Description of Artificial Sequence: Synthetic peptide
KTKPYW

SEQ ID NO: 2160 - protein, 7 aa, Artificial Sequence
  Description of Artificial Sequence: Synthetic peptide
KTKPYRW

SEQ ID NO: 2161 - protein, 7 aa, Artificial Sequence
  Description of Artificial Sequence: Synthetic peptide
KTKPYFW

SEQ ID NO: 2162 - protein, 7 aa, Artificial Sequence
  Description of Artificial Sequence: Synthetic peptide
KTKPYYW

SEQ ID NO: 2163 - protein, 7 aa, Artificial Sequence
  Description of Artificial Sequence: Synthetic peptide
KTKPYHW

SEQ ID NO: 2164 - protein, 7 aa, Artificial Sequence
  Description of Artificial Sequence: Synthetic peptide
KTKPYPW

SEQ ID NO: 2165 - protein, 7 aa, Artificial Sequence
  Description of Artificial Sequence: Synthetic peptide
KTKPYKW

SEQ ID NO: 2166 - protein, 6 aa, Artificial Sequence
  Description of Artificial Sequence: Synthetic peptide
KTKPRW

SEQ ID NO: 2167 - protein, 7 aa, Artificial Sequence
  Description of Artificial Sequence: Synthetic peptide
KTKPRRW

SEQ ID NO: 2168 - protein, 7 aa, Artificial Sequence
  Description of Artificial Sequence: Synthetic peptide
KTKPRFW

SEQ ID NO: 2169 - protein, 7 aa, Artificial Sequence
  Description of Artificial Sequence: Synthetic peptide
KTKPRYW

SEQ ID NO: 2170 - protein, 7 aa, Artificial Sequence
  Description of Artificial Sequence: Synthetic peptide
KTKPRHW

SEQ ID NO: 2171 - protein, 7 aa, Artificial Sequence
  Description of Artificial Sequence: Synthetic peptide
KTKPRPW

SEQ ID NO: 2172 - protein, 7 aa, Artificial Sequence
  Description of Artificial Sequence: Synthetic peptide
KTKPRKW

SEQ ID NO: 2173 - protein, 5 aa, Artificial Sequence
  Description of Artificial Sequence: Synthetic peptide
GTKPW

SEQ ID NO: 2174 - protein, 6 aa, Artificial Sequence
  Description of Artificial Sequence: Synthetic peptide
GTKPRW

SEQ ID NO: 2175 - protein, 6 aa, Artificial Sequence
  Description of Artificial Sequence: Synthetic peptide
GTKPFW

SEQ ID NO: 2176 - protein, 6 aa, Artificial Sequence
  Description of Artificial Sequence: Synthetic peptide
GTKPYW

SEQ ID NO: 2177 - protein, 6 aa, Artificial Sequence
  Description of Artificial Sequence: Synthetic peptide
GTKPGW

SEQ ID NO: 2178 - protein, 6 aa, Artificial Sequence
  Description of Artificial Sequence: Synthetic peptide
GTKPHW

SEQ ID NO: 2179 - protein, 6 aa, Artificial Sequence
  Description of Artificial Sequence: Synthetic peptide
GTKPKW

SEQ ID NO: 2180 - protein, 6 aa, Artificial Sequence
  Description of Artificial Sequence: Synthetic peptide
GTKPGW

SEQ ID NO: 2181 - protein, 7 aa, Artificial Sequence
  Description of Artificial Sequence: Synthetic peptide
GTKPGRW

SEQ ID NO: 2182 - protein, 7 aa, Artificial Sequence
  Description of Artificial Sequence: Synthetic peptide
GTKPGFW

SEQ ID NO: 2183 - protein, 7 aa, Artificial Sequence
  Description of Artificial Sequence: Synthetic peptide
GTKPGYW

SEQ ID NO: 2184 - protein, 7 aa, Artificial Sequence
  Description of Artificial Sequence: Synthetic peptide
GTKPGHW

SEQ ID NO: 2185 - protein, 7 aa, Artificial Sequence
  Description of Artificial Sequence: Synthetic peptide
GTKPGPW

SEQ ID NO: 2186 - protein, 7 aa, Artificial Sequence
  Description of Artificial Sequence: Synthetic peptide
GTKPGKW

SEQ ID NO: 2187 - protein, 6 aa, Artificial Sequence
  Description of Artificial Sequence: Synthetic peptide
GTKPDW

SEQ ID NO: 2188 - protein, 7 aa, Artificial Sequence
  Description of Artificial Sequence: Synthetic peptide
GTKPDRW

SEQ ID NO: 2189 - protein, 7 aa, Artificial Sequence
  Description of Artificial Sequence: Synthetic peptide
GTKPDFW

SEQ ID NO: 2190 - protein, 7 aa, Artificial Sequence
  Description of Artificial Sequence: Synthetic peptide
GTKPDYW

SEQ ID NO: 2191 - protein, 7 aa, Artificial Sequence
  Description of Artificial Sequence: Synthetic peptide
GTKPDHW

SEQ ID NO: 2192 - protein, 7 aa, Artificial Sequence
  Description of Artificial Sequence: Synthetic peptide
GTKPDPW

SEQ ID NO: 2193 - protein, 7 aa, Artificial Sequence
  Description of Artificial Sequence: Synthetic peptide
GTKPDKW

SEQ ID NO: 2194 - protein, 6 aa, Artificial Sequence
  Description of Artificial Sequence: Synthetic peptide
GTKPWW

SEQ ID NO: 2195 - protein, 7 aa, Artificial Sequence
  Description of Artificial Sequence: Synthetic peptide
GTKPWRW

SEQ ID NO: 2196 - protein, 7 aa, Artificial Sequence
  Description of Artificial Sequence: Synthetic peptide
GTKPWFW

SEQ ID NO: 2197 - protein, 7 aa, Artificial Sequence
  Description of Artificial Sequence: Synthetic peptide
GTKPWYW

SEQ ID NO: 2198 - protein, 7 aa, Artificial Sequence
  Description of Artificial Sequence: Synthetic peptide
GTKPWHW

SEQ ID NO: 2199 - protein, 7 aa, Artificial Sequence
  Description of Artificial Sequence: Synthetic peptide
GTKPWPW

SEQ ID NO: 2200 - protein, 7 aa, Artificial Sequence
  Description of Artificial Sequence: Synthetic peptide
GTKPWKW

SEQ ID NO: 2201 - protein, 6 aa, Artificial Sequence
  Description of Artificial Sequence: Synthetic peptide
GTKPQW

SEQ ID NO: 2202 - protein, 7 aa, Artificial Sequence
  Description of Artificial Sequence: Synthetic peptide
GTKPQRW

SEQ ID NO: 2203 - protein, 7 aa, Artificial Sequence
  Description of Artificial Sequence: Synthetic peptide
GTKPQFW

SEQ ID NO: 2204 - protein, 7 aa, Artificial Sequence
  Description of Artificial Sequence: Synthetic peptide
GTKPQYW

SEQ ID NO: 2205 - protein, 7 aa, Artificial Sequence
  Description of Artificial Sequence: Synthetic peptide
GTKPQHW

SEQ ID NO: 2206 - protein, 7 aa, Artificial Sequence
  Description of Artificial Sequence: Synthetic peptide
GTKPQPW

SEQ ID NO: 2207 - protein, 7 aa, Artificial Sequence
  Description of Artificial Sequence: Synthetic peptide
GTKPQKW

SEQ ID NO: 2208 - protein, 6 aa, Artificial Sequence
  Description of Artificial Sequence: Synthetic peptide
GTKPNW

SEQ ID NO: 2209 - protein, 7 aa, Artificial Sequence
  Description of Artificial Sequence: Synthetic peptide
GTKPNRW

SEQ ID NO: 2210 - protein, 7 aa, Artificial Sequence
  Description of Artificial Sequence: Synthetic peptide
GTKPNFW

SEQ ID NO: 2211 - protein, 7 aa, Artificial Sequence
  Description of Artificial Sequence: Synthetic peptide
GTKPNYW

SEQ ID NO: 2212 - protein, 7 aa, Artificial Sequence
  Description of Artificial Sequence: Synthetic peptide
GTKPNHW

SEQ ID NO: 2213 - protein, 7 aa, Artificial Sequence
  Description of Artificial Sequence: Synthetic peptide
GTKPNPW

SEQ ID NO: 2214 - protein, 7 aa, Artificial Sequence
  Description of Artificial Sequence: Synthetic peptide
GTKPNKW

SEQ ID NO: 2215 - protein, 6 aa, Artificial Sequence
  Description of Artificial Sequence: Synthetic peptide
GTKPYW

SEQ ID NO: 2216 - protein, 7 aa, Artificial Sequence
  Description of Artificial Sequence: Synthetic peptide
GTKPYRW

SEQ ID NO: 2217 - protein, 7 aa, Artificial Sequence
  Description of Artificial Sequence: Synthetic peptide
GTKPYFW

SEQ ID NO: 2218 - protein, 7 aa, Artificial Sequence
  Description of Artificial Sequence: Synthetic peptide
GTKPYYW

SEQ ID NO: 2219 - protein, 7 aa, Artificial Sequence
  Description of Artificial Sequence: Synthetic peptide
GTKPYHW

SEQ ID NO: 2220 - protein, 7 aa, Artificial Sequence
  Description of Artificial Sequence: Synthetic peptide
GTKPYPW

SEQ ID NO: 2221 - protein, 7 aa, Artificial Sequence
  Description of Artificial Sequence: Synthetic peptide
GTKPYKW

SEQ ID NO: 2222 - protein, 6 aa, Artificial Sequence
  Description of Artificial Sequence: Synthetic peptide
GTKPRW

SEQ ID NO: 2223 - protein, 7 aa, Artificial Sequence
  Description of Artificial Sequence: Synthetic peptide
GTKPRRW

SEQ ID NO: 2224 - protein, 7 aa, Artificial Sequence
  Description of Artificial Sequence: Synthetic peptide
GTKPRFW

SEQ ID NO: 2225 - protein, 7 aa, Artificial Sequence
  Description of Artificial Sequence: Synthetic peptide
GTKPRYW

SEQ ID NO: 2226 - protein, 7 aa, Artificial Sequence
  Description of Artificial Sequence: Synthetic peptide
GTKPRHW

SEQ ID NO: 2227 - protein, 7 aa, Artificial Sequence
  Description of Artificial Sequence: Synthetic peptide
GTKPRPW

SEQ ID NO: 2228 - protein, 7 aa, Artificial Sequence
  Description of Artificial Sequence: Synthetic peptide
GTKPRKW

SEQ ID NO: 2229 - protein, 5 aa, Artificial Sequence
  Description of Artificial Sequence: Synthetic peptide
TKPRF

SEQ ID NO: 2230 - protein, 5 aa, Artificial Sequence
  Description of Artificial Sequence: Synthetic peptide
TKPFF

SEQ ID NO: 2231 - protein, 5 aa, Artificial Sequence
  Description of Artificial Sequence: Synthetic peptide
TKPYF

SEQ ID NO: 2232 - protein, 5 aa, Artificial Sequence
  Description of Artificial Sequence: Synthetic peptide
TKPGF

SEQ ID NO: 2233 - protein, 5 aa, Artificial Sequence
  Description of Artificial Sequence: Synthetic peptide
TKPHF

SEQ ID NO: 2234 - protein, 5 aa, Artificial Sequence
  Description of Artificial Sequence: Synthetic peptide
TKPKF

SEQ ID NO: 2235 - protein, 5 aa, Artificial Sequence
  Description of Artificial Sequence: Synthetic peptide
TKPGF

SEQ ID NO: 2236 - protein, 6 aa, Artificial Sequence
  Description of Artificial Sequence: Synthetic peptide
TKPGRF

SEQ ID NO: 2237 - protein, 6 aa, Artificial Sequence
  Description of Artificial Sequence: Synthetic peptide
TKPGFF

SEQ ID NO: 2238 - protein, 6 aa, Artificial Sequence
  Description of Artificial Sequence: Synthetic peptide
TKPGYF

SEQ ID NO: 2239 - protein, 6 aa, Artificial Sequence
  Description of Artificial Sequence: Synthetic peptide
TKPGHF

SEQ ID NO: 2240 - protein, 6 aa, Artificial Sequence
  Description of Artificial Sequence: Synthetic peptide
TKPGPF

SEQ ID NO: 2241 - protein, 6 aa, Artificial Sequence
  Description of Artificial Sequence: Synthetic peptide
TKPGKF

SEQ ID NO: 2242 - protein, 5 aa, Artificial Sequence
  Description of Artificial Sequence: Synthetic peptide
TKPDF

SEQ ID NO: 2243 - protein, 6 aa, Artificial Sequence
  Description of Artificial Sequence: Synthetic peptide
TKPDRF

SEQ ID NO: 2244 - protein, 6 aa, Artificial Sequence
  Description of Artificial Sequence: Synthetic peptide
TKPDFF

SEQ ID NO: 2245 - protein, 6 aa, Artificial Sequence
  Description of Artificial Sequence: Synthetic peptide
TKPDYF

SEQ ID NO: 2246 - protein, 6 aa, Artificial Sequence
  Description of Artificial Sequence: Synthetic peptide
TKPDHF

SEQ ID NO: 2247 - protein, 6 aa, Artificial Sequence
  Description of Artificial Sequence: Synthetic peptide
TKPDPF

SEQ ID NO: 2248 - protein, 6 aa, Artificial Sequence
  Description of Artificial Sequence: Synthetic peptide
TKPDKF

SEQ ID NO: 2249 - protein, 5 aa, Artificial Sequence
  Description of Artificial Sequence: Synthetic peptide
TKPWF

SEQ ID NO: 2250 - protein, 6 aa, Artificial Sequence
  Description of Artificial Sequence: Synthetic peptide
TKPWRF

SEQ ID NO: 2251 - protein, 6 aa, Artificial Sequence
  Description of Artificial Sequence: Synthetic peptide
TKPWFF

SEQ ID NO: 2252 - protein, 6 aa, Artificial Sequence
  Description of Artificial Sequence: Synthetic peptide
TKPWYF

SEQ ID NO: 2253 - protein, 6 aa, Artificial Sequence
  Description of Artificial Sequence: Synthetic peptide
TKPWHF

SEQ ID NO: 2254 - protein, 6 aa, Artificial Sequence
  Description of Artificial Sequence: Synthetic peptide
TKPWPF

SEQ ID NO: 2255 - protein, 6 aa, Artificial Sequence
  Description of Artificial Sequence: Synthetic peptide
TKPWKF

SEQ ID NO: 2256 - protein, 5 aa, Artificial Sequence
  Description of Artificial Sequence: Synthetic peptide
TKPQF

SEQ ID NO: 2257 - protein, 6 aa, Artificial Sequence
  Description of Artificial Sequence: Synthetic peptide
TKPQRF

SEQ ID NO: 2258 - protein, 6 aa, Artificial Sequence
  Description of Artificial Sequence: Synthetic peptide
TKPQFF

SEQ ID NO: 2259 - protein, 6 aa, Artificial Sequence
  Description of Artificial Sequence: Synthetic peptide
TKPQYF

SEQ ID NO: 2260 - protein, 6 aa, Artificial Sequence
  Description of Artificial Sequence: Synthetic peptide
TKPQHF

SEQ ID NO: 2261 - protein, 6 aa, Artificial Sequence
  Description of Artificial Sequence: Synthetic peptide
TKPQPF

SEQ ID NO: 2262 - protein, 6 aa, Artificial Sequence
  Description of Artificial Sequence: Synthetic peptide
TKPQKF

SEQ ID NO: 2263 - protein, 5 aa, Artificial Sequence
  Description of Artificial Sequence: Synthetic peptide
TKPNF

SEQ ID NO: 2264 - protein, 6 aa, Artificial Sequence
  Description of Artificial Sequence: Synthetic peptide
TKPNRF

SEQ ID NO: 2265 - protein, 6 aa, Artificial Sequence
  Description of Artificial Sequence: Synthetic peptide
TKPNFF

SEQ ID NO: 2266 - protein, 6 aa, Artificial Sequence
  Description of Artificial Sequence: Synthetic peptide
TKPNYF

SEQ ID NO: 2267 - protein, 6 aa, Artificial Sequence
  Description of Artificial Sequence: Synthetic peptide
TKPNHF

SEQ ID NO: 2268 - protein, 6 aa, Artificial Sequence
  Description of Artificial Sequence: Synthetic peptide
TKPNPF

SEQ ID NO: 2269 - protein, 6 aa, Artificial Sequence
  Description of Artificial Sequence: Synthetic peptide
TKPNKF

SEQ ID NO: 2270 - protein, 5 aa, Artificial Sequence
  Description of Artificial Sequence: Synthetic peptide
TKPYF

SEQ ID NO: 2271 - protein, 6 aa, Artificial Sequence
  Description of Artificial Sequence: Synthetic peptide
TKPYRF

SEQ ID NO: 2272 - protein, 6 aa, Artificial Sequence
  Description of Artificial Sequence: Synthetic peptide
TKPYFF

SEQ ID NO: 2273 - protein, 6 aa, Artificial Sequence
  Description of Artificial Sequence: Synthetic peptide
TKPYYF

SEQ ID NO: 2274 - protein, 6 aa, Artificial Sequence
  Description of Artificial Sequence: Synthetic peptide
TKPYHF

SEQ ID NO: 2275 - protein, 6 aa, Artificial Sequence
  Description of Artificial Sequence: Synthetic peptide
TKPYPF

SEQ ID NO: 2276 - protein, 6 aa, Artificial Sequence
  Description of Artificial Sequence: Synthetic peptide
TKPYKF

SEQ ID NO: 2277 - protein, 5 aa, Artificial Sequence
  Description of Artificial Sequence: Synthetic peptide
TKPRF

SEQ ID NO: 2278 - protein, 6 aa, Artificial Sequence
  Description of Artificial Sequence: Synthetic peptide
TKPRRF

SEQ ID NO: 2279 - protein, 6 aa, Artificial Sequence
  Description of Artificial Sequence: Synthetic peptide
TKPRFF

SEQ ID NO: 2280 - protein, 6 aa, Artificial Sequence
  Description of Artificial Sequence: Synthetic peptide
TKPRYF

SEQ ID NO: 2281 - protein, 6 aa, Artificial Sequence
  Description of Artificial Sequence: Synthetic peptide
TKPRHF

SEQ ID NO: 2282 - protein, 6 aa, Artificial Sequence
  Description of Artificial Sequence: Synthetic peptide
TKPRKF

SEQ ID NO: 2283 - protein, 5 aa, Artificial Sequence
  Description of Artificial Sequence: Synthetic peptide
MTKPF

SEQ ID NO: 2284 - protein, 6 aa, Artificial Sequence
  Description of Artificial Sequence: Synthetic peptide
MTKPRF

SEQ ID NO: 2285 - protein, 6 aa, Artificial Sequence
  Description of Artificial Sequence: Synthetic peptide
MTKPFF

SEQ ID NO: 2286 - protein, 6 aa, Artificial Sequence
  Description of Artificial Sequence: Synthetic peptide
MTKPYF

SEQ ID NO: 2287 - protein, 6 aa, Artificial Sequence
  Description of Artificial Sequence: Synthetic peptide
MTKPGF

SEQ ID NO: 2288 - protein, 6 aa, Artificial Sequence
  Description of Artificial Sequence: Synthetic peptide
MTKPHF

SEQ ID NO: 2289 - protein, 6 aa, Artificial Sequence
  Description of Artificial Sequence: Synthetic peptide
MTKPKF

SEQ ID NO: 2290 - protein, 6 aa, Artificial Sequence
  Description of Artificial Sequence: Synthetic peptide
MTKPGF

SEQ ID NO: 2291 - protein, 7 aa, Artificial Sequence
  Description of Artificial Sequence: Synthetic peptide
MTKPGRF

SEQ ID NO: 2292 - protein, 7 aa, Artificial Sequence
  Description of Artificial Sequence: Synthetic peptide
MTKPGFF

SEQ ID NO: 2293 - protein, 7 aa, Artificial Sequence
  Description of Artificial Sequence: Synthetic peptide
MTKPGYF

SEQ ID NO: 2294 - protein, 7 aa, Artificial Sequence
  Description of Artificial Sequence: Synthetic peptide
MTKPGHF

SEQ ID NO: 2295 - protein, 7 aa, Artificial Sequence
  Description of Artificial Sequence: Synthetic peptide
MTKPGPF

SEQ ID NO: 2296 - protein, 7 aa, Artificial Sequence
  Description of Artificial Sequence: Synthetic peptide
MTKPGKF

SEQ ID NO: 2297 - protein, 6 aa, Artificial Sequence
  Description of Artificial Sequence: Synthetic peptide
MTKPDF

SEQ ID NO: 2298 - protein, 7 aa, Artificial Sequence
  Description of Artificial Sequence: Synthetic peptide
MTKPDRF

SEQ ID NO: 2299 - protein, 7 aa, Artificial Sequence
  Description of Artificial Sequence: Synthetic peptide
MTKPDFF

SEQ ID NO: 2300 - protein, 7 aa, Artificial Sequence
  Description of Artificial Sequence: Synthetic peptide
MTKPDYF

SEQ ID NO: 2301 - protein, 7 aa, Artificial Sequence
  Description of Artificial Sequence: Synthetic peptide
MTKPDHF

SEQ ID NO: 2302 - protein, 7 aa, Artificial Sequence
  Description of Artificial Sequence: Synthetic peptide
MTKPDPF

SEQ ID NO: 2303 - protein, 7 aa, Artificial Sequence
  Description of Artificial Sequence: Synthetic peptide
MTKPDKF

SEQ ID NO: 2304 - protein, 6 aa, Artificial Sequence
  Description of Artificial Sequence: Synthetic peptide
MTKPWF

SEQ ID NO: 2305 - protein, 7 aa, Artificial Sequence
  Description of Artificial Sequence: Synthetic peptide
MTKPWRF

SEQ ID NO: 2306 - protein, 7 aa, Artificial Sequence
  Description of Artificial Sequence: Synthetic peptide
MTKPWFF

SEQ ID NO: 2307 - protein, 7 aa, Artificial Sequence
  Description of Artificial Sequence: Synthetic peptide
MTKPWYF

SEQ ID NO: 2308 - protein, 7 aa, Artificial Sequence
  Description of Artificial Sequence: Synthetic peptide
MTKPWHF

SEQ ID NO: 2309 - protein, 7 aa, Artificial Sequence
  Description of Artificial Sequence: Synthetic peptide
MTKPWPF

SEQ ID NO: 2310 - protein, 7 aa, Artificial Sequence
  Description of Artificial Sequence: Synthetic peptide
MTKPWKF

SEQ ID NO: 2311 - protein, 6 aa, Artificial Sequence
  Description of Artificial Sequence: Synthetic peptide
MTKPQF

SEQ ID NO: 2312 - protein, 7 aa, Artificial Sequence
  Description of Artificial Sequence: Synthetic peptide
MTKPQRF

SEQ ID NO: 2313 - protein, 7 aa, Artificial Sequence
  Description of Artificial Sequence: Synthetic peptide
MTKPQFF

SEQ ID NO: 2314 - protein, 7 aa, Artificial Sequence
  Description of Artificial Sequence: Synthetic peptide
MTKPQYF

SEQ ID NO: 2315 - protein, 7 aa, Artificial Sequence
  Description of Artificial Sequence: Synthetic peptide
MTKPQHF

SEQ ID NO: 2316 - protein, 7 aa, Artificial Sequence
  Description of Artificial Sequence: Synthetic peptide
MTKPQPF

SEQ ID NO: 2317 - protein, 7 aa, Artificial Sequence
  Description of Artificial Sequence: Synthetic peptide
MTKPQKF

SEQ ID NO: 2318 - protein, 6 aa, Artificial Sequence
  Description of Artificial Sequence: Synthetic peptide
MTKPNF

SEQ ID NO: 2319 - protein, 7 aa, Artificial Sequence
  Description of Artificial Sequence: Synthetic peptide
MTKPNRF

SEQ ID NO: 2320 - protein, 7 aa, Artificial Sequence
  Description of Artificial Sequence: Synthetic peptide
MTKPNFF

SEQ ID NO: 2321 - protein, 7 aa, Artificial Sequence
  Description of Artificial Sequence: Synthetic peptide
MTKPNYF

SEQ ID NO: 2322 - protein, 7 aa, Artificial Sequence
  Description of Artificial Sequence: Synthetic peptide
MTKPNHF

SEQ ID NO: 2323 - protein, 7 aa, Artificial Sequence
  Description of Artificial Sequence: Synthetic peptide
MTKPNPF

SEQ ID NO: 2324 - protein, 7 aa, Artificial Sequence
  Description of Artificial Sequence: Synthetic peptide
MTKPNKF

SEQ ID NO: 2325 - protein, 6 aa, Artificial Sequence
  Description of Artificial Sequence: Synthetic peptide
MTKPYF

SEQ ID NO: 2326 - protein, 7 aa, Artificial Sequence
  Description of Artificial Sequence: Synthetic peptide
MTKPYRF

SEQ ID NO: 2327 - protein, 7 aa, Artificial Sequence
  Description of Artificial Sequence: Synthetic peptide
MTKPYFF

SEQ ID NO: 2328 - protein, 7 aa, Artificial Sequence
  Description of Artificial Sequence: Synthetic peptide
MTKPYYF

SEQ ID NO: 2329 - protein, 7 aa, Artificial Sequence
  Description of Artificial Sequence: Synthetic peptide
MTKPYHF

SEQ ID NO: 2330 - protein, 7 aa, Artificial Sequence
  Description of Artificial Sequence: Synthetic peptide
MTKPYPF

SEQ ID NO: 2331 - protein, 7 aa, Artificial Sequence
  Description of Artificial Sequence: Synthetic peptide
MTKPYKF

SEQ ID NO: 2332 - protein, 6 aa, Artificial Sequence
  Description of Artificial Sequence: Synthetic peptide
MTKPRF

SEQ ID NO: 2333 - protein, 7 aa, Artificial Sequence
  Description of Artificial Sequence: Synthetic peptide
MTKPRRF

SEQ ID NO: 2334 - protein, 7 aa, Artificial Sequence
  Description of Artificial Sequence: Synthetic peptide
MTKPRFF

SEQ ID NO: 2335 - protein, 7 aa, Artificial Sequence
  Description of Artificial Sequence: Synthetic peptide
MTKPRYF

SEQ ID NO: 2336 - protein, 7 aa, Artificial Sequence
  Description of Artificial Sequence: Synthetic peptide
MTKPRHF

SEQ ID NO: 2337 - protein, 7 aa, Artificial Sequence
  Description of Artificial Sequence: Synthetic peptide
MTKPRPF

SEQ ID NO: 2338 - protein, 7 aa, Artificial Sequence
  Description of Artificial Sequence: Synthetic peptide
MTKPRKF

SEQ ID NO: 2339 - protein, 5 aa, Artificial Sequence
  Description of Artificial Sequence: Synthetic peptide
MTKPF

SEQ ID NO: 2340 - protein, 6 aa, Artificial Sequence
  Description of Artificial Sequence: Synthetic peptide
MTKPRF

SEQ ID NO: 2341 - protein, 6 aa, Artificial Sequence
  Description of Artificial Sequence: Synthetic peptide
MTKPFF

SEQ ID NO: 2342 - protein, 6 aa, Artificial Sequence
  Description of Artificial Sequence: Synthetic peptide
MTKPYF

SEQ ID NO: 2343 - protein, 6 aa, Artificial Sequence
  Description of Artificial Sequence: Synthetic peptide
MTKPGF

SEQ ID NO: 2344 - protein, 6 aa, Artificial Sequence
  Description of Artificial Sequence: Synthetic peptide
MTKPHF

SEQ ID NO: 2345 - protein, 6 aa, Artificial Sequence
  Description of Artificial Sequence: Synthetic peptide
MTKPKF

SEQ ID NO: 2346 - protein, 6 aa, Artificial Sequence
  Description of Artificial Sequence: Synthetic peptide
MTKPGF

SEQ ID NO: 2347 - protein, 7 aa, Artificial Sequence
  Description of Artificial Sequence: Synthetic peptide
MTKPGRF

SEQ ID NO: 2348 - protein, 7 aa, Artificial Sequence
  Description of Artificial Sequence: Synthetic peptide
MTKPGFF

SEQ ID NO: 2349 - protein, 7 aa, Artificial Sequence
  Description of Artificial Sequence: Synthetic peptide
MTKPGYF

SEQ ID NO: 2350 - protein, 7 aa, Artificial Sequence
  Description of Artificial Sequence: Synthetic peptide
MTKPGHF

SEQ ID NO: 2351 - protein, 7 aa, Artificial Sequence
  Description of Artificial Sequence: Synthetic peptide
MTKPGPF

SEQ ID NO: 2352 - protein, 7 aa, Artificial Sequence
  Description of Artificial Sequence: Synthetic peptide
MTKPGKF

SEQ ID NO: 2353 - protein, 6 aa, Artificial Sequence
  Description of Artificial Sequence: Synthetic peptide
MTKPDF

SEQ ID NO: 2354 - protein, 7 aa, Artificial Sequence
  Description of Artificial Sequence: Synthetic peptide
MTKPDRF

SEQ ID NO: 2355 - protein, 7 aa, Artificial Sequence
  Description of Artificial Sequence: Synthetic peptide
MTKPDFF

SEQ ID NO: 2356 - protein, 7 aa, Artificial Sequence
  Description of Artificial Sequence: Synthetic peptide
MTKPDYF

SEQ ID NO: 2357 - protein, 7 aa, Artificial Sequence
  Description of Artificial Sequence: Synthetic peptide
MTKPDHF

SEQ ID NO: 2358 - protein, 7 aa, Artificial Sequence
  Description of Artificial Sequence: Synthetic peptide
MTKPDPF

SEQ ID NO: 2359 - protein, 7 aa, Artificial Sequence
  Description of Artificial Sequence: Synthetic peptide
MTKPDKF

SEQ ID NO: 2360 - protein, 6 aa, Artificial Sequence
  Description of Artificial Sequence: Synthetic peptide
MTKPWF

SEQ ID NO: 2361 - protein, 7 aa, Artificial Sequence
  Description of Artificial Sequence: Synthetic peptide
MTKPWRF

SEQ ID NO: 2362 - protein, 7 aa, Artificial Sequence
  Description of Artificial Sequence: Synthetic peptide
MTKPWFF

SEQ ID NO: 2363 - protein, 7 aa, Artificial Sequence
  Description of Artificial Sequence: Synthetic peptide
MTKPWYF

SEQ ID NO: 2364 - protein, 7 aa, Artificial Sequence
  Description of Artificial Sequence: Synthetic peptide
MTKPWHF

SEQ ID NO: 2365 - protein, 7 aa, Artificial Sequence
  Description of Artificial Sequence: Synthetic peptide
MTKPWPF

SEQ ID NO: 2366 - protein, 7 aa, Artificial Sequence
  Description of Artificial Sequence: Synthetic peptide
MTKPWKF

SEQ ID NO: 2367 - protein, 6 aa, Artificial Sequence
  Description of Artificial Sequence: Synthetic peptide
MTKPQF

SEQ ID NO: 2368 - protein, 7 aa, Artificial Sequence
  Description of Artificial Sequence: Synthetic peptide
MTKPQRF

SEQ ID NO: 2369 - protein, 7 aa, Artificial Sequence
  Description of Artificial Sequence: Synthetic peptide
MTKPQFF

SEQ ID NO: 2370 - protein, 7 aa, Artificial Sequence
  Description of Artificial Sequence: Synthetic peptide
MTKPQYF

SEQ ID NO: 2371 - protein, 7 aa, Artificial Sequence
  Description of Artificial Sequence: Synthetic peptide
MTKPQHF

SEQ ID NO: 2372 - protein, 7 aa, Artificial Sequence
  Description of Artificial Sequence: Synthetic peptide
MTKPQPF

SEQ ID NO: 2373 - protein, 7 aa, Artificial Sequence
  Description of Artificial Sequence: Synthetic peptide
MTKPQKF

SEQ ID NO: 2374 - protein, 6 aa, Artificial Sequence
  Description of Artificial Sequence: Synthetic peptide
MTKPNF

SEQ ID NO: 2375 - protein, 7 aa, Artificial Sequence
  Description of Artificial Sequence: Synthetic peptide
MTKPNRF

SEQ ID NO: 2376 - protein, 7 aa, Artificial Sequence
  Description of Artificial Sequence: Synthetic peptide
MTKPNFF

SEQ ID NO: 2377 - protein, 7 aa, Artificial Sequence
  Description of Artificial Sequence: Synthetic peptide
MTKPNYF

SEQ ID NO: 2378 - protein, 7 aa, Artificial Sequence
  Description of Artificial Sequence: Synthetic peptide
MTKPNHF

SEQ ID NO: 2379 - protein, 7 aa, Artificial Sequence
  Description of Artificial Sequence: Synthetic peptide
MTKPNPF

SEQ ID NO: 2380 - protein, 7 aa, Artificial Sequence
  Description of Artificial Sequence: Synthetic peptide
MTKPNKF

SEQ ID NO: 2381 - protein, 6 aa, Artificial Sequence
  Description of Artificial Sequence: Synthetic peptide
MTKPYF

SEQ ID NO: 2382 - protein, 7 aa, Artificial Sequence
  Description of Artificial Sequence: Synthetic peptide
MTKPYRF

SEQ ID NO: 2383 - protein, 7 aa, Artificial Sequence
  Description of Artificial Sequence: Synthetic peptide
MTKPYFF

SEQ ID NO: 2384 - protein, 7 aa, Artificial Sequence
  Description of Artificial Sequence: Synthetic peptide
MTKPYYF

SEQ ID NO: 2385 - protein, 7 aa, Artificial Sequence
  Description of Artificial Sequence: Synthetic peptide
MTKPYHF

SEQ ID NO: 2386 - protein, 7 aa, Artificial Sequence
  Description of Artificial Sequence: Synthetic peptide
MTKPYPF

SEQ ID NO: 2387 - protein, 7 aa, Artificial Sequence
  Description of Artificial Sequence: Synthetic peptide
MTKPYKF

SEQ ID NO: 2388 - protein, 6 aa, Artificial Sequence
  Description of Artificial Sequence: Synthetic peptide
MTKPRF

SEQ ID NO: 2389 - protein, 7 aa, Artificial Sequence
  Description of Artificial Sequence: Synthetic peptide
MTKPRRF

SEQ ID NO: 2390 - protein, 7 aa, Artificial Sequence
  Description of Artificial Sequence: Synthetic peptide
MTKPRFF

SEQ ID NO: 2391 - protein, 7 aa, Artificial Sequence
  Description of Artificial Sequence: Synthetic peptide
MTKPRYF

SEQ ID NO: 2392 - protein, 7 aa, Artificial Sequence
  Description of Artificial Sequence: Synthetic peptide
MTKPRHF

SEQ ID NO: 2393 - protein, 7 aa, Artificial Sequence
  Description of Artificial Sequence: Synthetic peptide
MTKPRPF

SEQ ID NO: 2394 - protein, 7 aa, Artificial Sequence
  Description of Artificial Sequence: Synthetic peptide
MTKPRKF

SEQ ID NO: 2395 - protein, 5 aa, Artificial Sequence
  Description of Artificial Sequence: Synthetic peptide
TTKPF

SEQ ID NO: 2396 - protein, 6 aa, Artificial Sequence
  Description of Artificial Sequence: Synthetic peptide
TTKPRF

SEQ ID NO: 2397 - protein, 6 aa, Artificial Sequence
  Description of Artificial Sequence: Synthetic peptide
TTKPFF

SEQ ID NO: 2398 - protein, 6 aa, Artificial Sequence
  Description of Artificial Sequence: Synthetic peptide
TTKPYF

SEQ ID NO: 2399 - protein, 6 aa, Artificial Sequence
  Description of Artificial Sequence: Synthetic peptide
TTKPGF

SEQ ID NO: 2400 - protein, 6 aa, Artificial Sequence
  Description of Artificial Sequence: Synthetic peptide
TTKPHF

SEQ ID NO: 2401 - protein, 6 aa, Artificial Sequence
  Description of Artificial Sequence: Synthetic peptide
TTKPKF

SEQ ID NO: 2402 - protein, 6 aa, Artificial Sequence
  Description of Artificial Sequence: Synthetic peptide
TTKPGF

SEQ ID NO: 2403 - protein, 7 aa, Artificial Sequence
  Description of Artificial Sequence: Synthetic peptide
TTKPGRF

SEQ ID NO: 2404 - protein, 7 aa, Artificial Sequence
  Description of Artificial Sequence: Synthetic peptide
TTKPGFF

SEQ ID NO: 2405 - protein, 7 aa, Artificial Sequence
  Description of Artificial Sequence: Synthetic peptide
TTKPGYF

SEQ ID NO: 2406 - protein, 7 aa, Artificial Sequence
  Description of Artificial Sequence: Synthetic peptide
TTKPGHF

SEQ ID NO: 2407 - protein, 7 aa, Artificial Sequence
  Description of Artificial Sequence: Synthetic peptide
TTKPGPF

SEQ ID NO: 2408 - protein, 7 aa, Artificial Sequence
  Description of Artificial Sequence: Synthetic peptide
TTKPGKF

SEQ ID NO: 2409 - protein, 6 aa, Artificial Sequence
  Description of Artificial Sequence: Synthetic peptide
TTKPDF

SEQ ID NO: 2410 - protein, 7 aa, Artificial Sequence
  Description of Artificial Sequence: Synthetic peptide
TTKPDRF

SEQ ID NO: 2411 - protein, 7 aa, Artificial Sequence
  Description of Artificial Sequence: Synthetic peptide
TTKPDFF

SEQ ID NO: 2412 - protein, 7 aa, Artificial Sequence
  Description of Artificial Sequence: Synthetic peptide
TTKPDYF

SEQ ID NO: 2413 - protein, 7 aa, Artificial Sequence
  Description of Artificial Sequence: Synthetic peptide
TTKPDHF

SEQ ID NO: 2414 - protein, 7 aa, Artificial Sequence
  Description of Artificial Sequence: Synthetic peptide
TTKPDPF

SEQ ID NO: 2415 - protein, 7 aa, Artificial Sequence
  Description of Artificial Sequence: Synthetic peptide
TTKPDKF

SEQ ID NO: 2416 - protein, 6 aa, Artificial Sequence
  Description of Artificial Sequence: Synthetic peptide
TTKPWF

SEQ ID NO: 2417 - protein, 7 aa, Artificial Sequence
  Description of Artificial Sequence: Synthetic peptide
TTKPWRF

SEQ ID NO: 2418 - protein, 7 aa, Artificial Sequence
  Description of Artificial Sequence: Synthetic peptide
TTKPWFF

SEQ ID NO: 2419 - protein, 7 aa, Artificial Sequence
  Description of Artificial Sequence: Synthetic peptide
TTKPWYF

SEQ ID NO: 2420 - protein, 7 aa, Artificial Sequence
  Description of Artificial Sequence: Synthetic peptide
TTKPWHF

SEQ ID NO: 2421 - protein, 7 aa, Artificial Sequence
  Description of Artificial Sequence: Synthetic peptide
TTKPWPF

SEQ ID NO: 2422 - protein, 7 aa, Artificial Sequence
  Description of Artificial Sequence: Synthetic peptide
TTKPWKF

SEQ ID NO: 2423 - protein, 6 aa, Artificial Sequence
  Description of Artificial Sequence: Synthetic peptide
TTKPQF

SEQ ID NO: 2424 - protein, 7 aa, Artificial Sequence
  Description of Artificial Sequence: Synthetic peptide
TTKPQRF

SEQ ID NO: 2425 - protein, 7 aa, Artificial Sequence
  Description of Artificial Sequence: Synthetic peptide
TTKPQFF

SEQ ID NO: 2426 - protein, 7 aa, Artificial Sequence
  Description of Artificial Sequence: Synthetic peptide
TTKPQYF

SEQ ID NO: 2427 - protein, 7 aa, Artificial Sequence
  Description of Artificial Sequence: Synthetic peptide
TTKPQHF

SEQ ID NO: 2428 - protein, 7 aa, Artificial Sequence
  Description of Artificial Sequence: Synthetic peptide
TTKPQPF

SEQ ID NO: 2429 - protein, 7 aa, Artificial Sequence
  Description of Artificial Sequence: Synthetic peptide
TTKPQKF

SEQ ID NO: 2430 - protein, 6 aa, Artificial Sequence
  Description of Artificial Sequence: Synthetic peptide
TTKPNF

SEQ ID NO: 2431 - protein, 7 aa, Artificial Sequence
  Description of Artificial Sequence: Synthetic peptide
TTKPNRF

SEQ ID NO: 2432 - protein, 7 aa, Artificial Sequence
  Description of Artificial Sequence: Synthetic peptide
TTKPNFF

SEQ ID NO: 2433 - protein, 7 aa, Artificial Sequence
  Description of Artificial Sequence: Synthetic peptide
TTKPNYF

SEQ ID NO: 2434 - protein, 7 aa, Artificial Sequence
  Description of Artificial Sequence: Synthetic peptide
TTKPNHF

SEQ ID NO: 2435 - protein, 7 aa, Artificial Sequence
  Description of Artificial Sequence: Synthetic peptide
TTKPNPF

SEQ ID NO: 2436 - protein, 7 aa, Artificial Sequence
  Description of Artificial Sequence: Synthetic peptide
TTKPNKF

SEQ ID NO: 2437 - protein, 6 aa, Artificial Sequence
  Description of Artificial Sequence: Synthetic peptide
TTKPYF

SEQ ID NO: 2438 - protein, 7 aa, Artificial Sequence
  Description of Artificial Sequence: Synthetic peptide
TTKPYRF

SEQ ID NO: 2439 - protein, 7 aa, Artificial Sequence
  Description of Artificial Sequence: Synthetic peptide
TTKPYFF

SEQ ID NO: 2440 - protein, 7 aa, Artificial Sequence
  Description of Artificial Sequence: Synthetic peptide
TTKPYYF

SEQ ID NO: 2441 - protein, 7 aa, Artificial Sequence
  Description of Artificial Sequence: Synthetic peptide
TTKPYHF

SEQ ID NO: 2442 - protein, 7 aa, Artificial Sequence
  Description of Artificial Sequence: Synthetic peptide
TTKPYPF

SEQ ID NO: 2443 - protein, 7 aa, Artificial Sequence
  Description of Artificial Sequence: Synthetic peptide
TTKPYKF

SEQ ID NO: 2444 - protein, 6 aa, Artificial Sequence
  Description of Artificial Sequence: Synthetic peptide
TTKPRF

SEQ ID NO: 2445 - protein, 7 aa, Artificial Sequence
  Description of Artificial Sequence: Synthetic peptide
TTKPRRF

SEQ ID NO: 2446 - protein, 7 aa, Artificial Sequence
  Description of Artificial Sequence: Synthetic peptide
TTKPRFF

SEQ ID NO: 2447 - protein, 7 aa, Artificial Sequence
  Description of Artificial Sequence: Synthetic peptide
TTKPRYF

SEQ ID NO: 2448 - protein, 7 aa, Artificial Sequence
  Description of Artificial Sequence: Synthetic peptide
TTKPRHF

SEQ ID NO: 2449 - protein, 7 aa, Artificial Sequence
  Description of Artificial Sequence: Synthetic peptide
TTKPRPF

SEQ ID NO: 2450 - protein, 7 aa, Artificial Sequence
  Description of Artificial Sequence: Synthetic peptide
TTKPRKF

SEQ ID NO: 2451 - protein, 5 aa, Artificial Sequence
  Description of Artificial Sequence: Synthetic peptide
ATKPF

SEQ ID NO: 2452 - protein, 6 aa, Artificial Sequence
  Description of Artificial Sequence: Synthetic peptide
ATKPRF

SEQ ID NO: 2453 - protein, 6 aa, Artificial Sequence
  Description of Artificial Sequence: Synthetic peptide
ATKPFF

SEQ ID NO: 2454 - protein, 6 aa, Artificial Sequence
  Description of Artificial Sequence: Synthetic peptide
ATKPYF

SEQ ID NO: 2455 - protein, 6 aa, Artificial Sequence
  Description of Artificial Sequence: Synthetic peptide
ATKPGF

SEQ ID NO: 2456 - protein, 6 aa, Artificial Sequence
  Description of Artificial Sequence: Synthetic peptide
ATKPHF

SEQ ID NO: 2457 - protein, 6 aa, Artificial Sequence
  Description of Artificial Sequence: Synthetic peptide
ATKPKF

SEQ ID NO: 2458 - protein, 6 aa, Artificial Sequence
  Description of Artificial Sequence: Synthetic peptide
ATKPGF

SEQ ID NO: 2459 - protein, 7 aa, Artificial Sequence
  Description of Artificial Sequence: Synthetic peptide
ATKPGRF

SEQ ID NO: 2460 - protein, 7 aa, Artificial Sequence
  Description of Artificial Sequence: Synthetic peptide
ATKPGFF

SEQ ID NO: 2461 - protein, 7 aa, Artificial Sequence
  Description of Artificial Sequence: Synthetic peptide
ATKPGYF

SEQ ID NO: 2462 - protein, 7 aa, Artificial Sequence
  Description of Artificial Sequence: Synthetic peptide
ATKPGHF

SEQ ID NO: 2463 - protein, 7 aa, Artificial Sequence
  Description of Artificial Sequence: Synthetic peptide
ATKPGPF

SEQ ID NO: 2464 - protein, 7 aa, Artificial Sequence
  Description of Artificial Sequence: Synthetic peptide
ATKPGKF

SEQ ID NO: 2465 - protein, 6 aa, Artificial Sequence
  Description of Artificial Sequence: Synthetic peptide
ATKPDF

SEQ ID NO: 2466 - protein, 7 aa, Artificial Sequence
  Description of Artificial Sequence: Synthetic peptide
ATKPDRF

SEQ ID NO: 2467 - protein, 7 aa, Artificial Sequence
  Description of Artificial Sequence: Synthetic peptide
ATKPDFF

SEQ ID NO: 2468 - protein, 7 aa, Artificial Sequence
  Description of Artificial Sequence: Synthetic peptide
ATKPDYF

SEQ ID NO: 2469 - protein, 7 aa, Artificial Sequence
  Description of Artificial Sequence: Synthetic peptide
ATKPDHF

SEQ ID NO: 2470 - protein, 7 aa, Artificial Sequence
  Description of Artificial Sequence: Synthetic peptide
ATKPDPF

SEQ ID NO: 2471 - protein, 7 aa, Artificial Sequence
  Description of Artificial Sequence: Synthetic peptide
ATKPDKF

SEQ ID NO: 2472 - protein, 6 aa, Artificial Sequence
  Description of Artificial Sequence: Synthetic peptide
ATKPWF

SEQ ID NO: 2473 - protein, 7 aa, Artificial Sequence
  Description of Artificial Sequence: Synthetic peptide
ATKPWRF

SEQ ID NO: 2474 - protein, 7 aa, Artificial Sequence
  Description of Artificial Sequence: Synthetic peptide
ATKPWFF

SEQ ID NO: 2475 - protein, 7 aa, Artificial Sequence
  Description of Artificial Sequence: Synthetic peptide
ATKPWYF

SEQ ID NO: 2476 - protein, 7 aa, Artificial Sequence
  Description of Artificial Sequence: Synthetic peptide
ATKPWHF

SEQ ID NO: 2477 - protein, 7 aa, Artificial Sequence
  Description of Artificial Sequence: Synthetic peptide
ATKPWPF

SEQ ID NO: 2478 - protein, 7 aa, Artificial Sequence
  Description of Artificial Sequence: Synthetic peptide
ATKPWKF

SEQ ID NO: 2479 - protein, 6 aa, Artificial Sequence
  Description of Artificial Sequence: Synthetic peptide
ATKPQF

SEQ ID NO: 2480 - protein, 7 aa, Artificial Sequence
  Description of Artificial Sequence: Synthetic peptide
ATKPQRF

SEQ ID NO: 2481 - protein, 7 aa, Artificial Sequence
  Description of Artificial Sequence: Synthetic peptide
ATKPQFF

SEQ ID NO: 2482 - protein, 7 aa, Artificial Sequence
  Description of Artificial Sequence: Synthetic peptide
ATKPQYF

SEQ ID NO: 2483 - protein, 7 aa, Artificial Sequence
  Description of Artificial Sequence: Synthetic peptide
ATKPQHF

SEQ ID NO: 2484 - protein, 7 aa, Artificial Sequence
  Description of Artificial Sequence: Synthetic peptide
ATKPQPF

SEQ ID NO: 2485 - protein, 7 aa, Artificial Sequence
  Description of Artificial Sequence: Synthetic peptide
ATKPQKF

SEQ ID NO: 2486 - protein, 6 aa, Artificial Sequence
  Description of Artificial Sequence: Synthetic peptide
ATKPNF

SEQ ID NO: 2487 - protein, 7 aa, Artificial Sequence
  Description of Artificial Sequence: Synthetic peptide
ATKPNRF

SEQ ID NO: 2488 - protein, 7 aa, Artificial Sequence
  Description of Artificial Sequence: Synthetic peptide
ATKPNFF

SEQ ID NO: 2489 - protein, 7 aa, Artificial Sequence
  Description of Artificial Sequence: Synthetic peptide
ATKPNYF

SEQ ID NO: 2490 - protein, 7 aa, Artificial Sequence
  Description of Artificial Sequence: Synthetic peptide
ATKPNHF

SEQ ID NO: 2491 - protein, 7 aa, Artificial Sequence
  Description of Artificial Sequence: Synthetic peptide
ATKPNPF

SEQ ID NO: 2492 - protein, 7 aa, Artificial Sequence
  Description of Artificial Sequence: Synthetic peptide
ATKPNKF

SEQ ID NO: 2493 - protein, 6 aa, Artificial Sequence
  Description of Artificial Sequence: Synthetic peptide
ATKPYF

SEQ ID NO: 2494 - protein, 7 aa, Artificial Sequence
  Description of Artificial Sequence: Synthetic peptide
ATKPYRF

SEQ ID NO: 2495 - protein, 7 aa, Artificial Sequence
  Description of Artificial Sequence: Synthetic peptide
ATKPYFF

SEQ ID NO: 2496 - protein, 7 aa, Artificial Sequence
  Description of Artificial Sequence: Synthetic peptide
ATKPYYF

SEQ ID NO: 2497 - protein, 7 aa, Artificial Sequence
  Description of Artificial Sequence: Synthetic peptide
ATKPYHF

SEQ ID NO: 2498 - protein, 7 aa, Artificial Sequence
  Description of Artificial Sequence: Synthetic peptide
ATKPYPF

SEQ ID NO: 2499 - protein, 7 aa, Artificial Sequence
  Description of Artificial Sequence: Synthetic peptide
ATKPYKF

SEQ ID NO: 2500 - protein, 6 aa, Artificial Sequence
  Description of Artificial Sequence: Synthetic peptide
ATKPRF

SEQ ID NO: 2501 - protein, 7 aa, Artificial Sequence
  Description of Artificial Sequence: Synthetic peptide
ATKPRRF

SEQ ID NO: 2502 - protein, 7 aa, Artificial Sequence
  Description of Artificial Sequence: Synthetic peptide
ATKPRFF

SEQ ID NO: 2503 - protein, 7 aa, Artificial Sequence
  Description of Artificial Sequence: Synthetic peptide
ATKPRYF

SEQ ID NO: 2504 - protein, 7 aa, Artificial Sequence
  Description of Artificial Sequence: Synthetic peptide
ATKPRHF

SEQ ID NO: 2505 - protein, 7 aa, Artificial Sequence
  Description of Artificial Sequence: Synthetic peptide
ATKPRPF

SEQ ID NO: 2506 - protein, 7 aa, Artificial Sequence
  Description of Artificial Sequence: Synthetic peptide
ATKPRKF

SEQ ID NO: 2507 - protein, 5 aa, Artificial Sequence
  Description of Artificial Sequence: Synthetic peptide
HTKPF

SEQ ID NO: 2508 - protein, 6 aa, Artificial Sequence
  Description of Artificial Sequence: Synthetic peptide
HTKPRF

SEQ ID NO: 2509 - protein, 6 aa, Artificial Sequence
  Description of Artificial Sequence: Synthetic peptide
HTKPFF

SEQ ID NO: 2510 - protein, 6 aa, Artificial Sequence
  Description of Artificial Sequence: Synthetic peptide
HTKPYF

SEQ ID NO: 2511 - protein, 6 aa, Artificial Sequence
  Description of Artificial Sequence: Synthetic peptide
HTKPGF

SEQ ID NO: 2512 - protein, 6 aa, Artificial Sequence
  Description of Artificial Sequence: Synthetic peptide
HTKPHF

SEQ ID NO: 2513 - protein, 6 aa, Artificial Sequence
  Description of Artificial Sequence: Synthetic peptide
HTKPKF

SEQ ID NO: 2514 - protein, 6 aa, Artificial Sequence
  Description of Artificial Sequence: Synthetic peptide
HTKPGF

SEQ ID NO: 2515 - protein, 7 aa, Artificial Sequence
  Description of Artificial Sequence: Synthetic peptide
HTKPGRF

SEQ ID NO: 2516 - protein, 7 aa, Artificial Sequence
  Description of Artificial Sequence: Synthetic peptide
HTKPGFF

SEQ ID NO: 2517 - protein, 7 aa, Artificial Sequence
  Description of Artificial Sequence: Synthetic peptide
HTKPGYF

SEQ ID NO: 2518 - protein, 7 aa, Artificial Sequence
  Description of Artificial Sequence: Synthetic peptide
HTKPGHF

SEQ ID NO: 2519 - protein, 7 aa, Artificial Sequence
  Description of Artificial Sequence: Synthetic peptide
HTKPGPF

SEQ ID NO: 2520 - protein, 7 aa, Artificial Sequence
  Description of Artificial Sequence: Synthetic peptide
HTKPGKF

SEQ ID NO: 2521 - protein, 6 aa, Artificial Sequence
  Description of Artificial Sequence: Synthetic peptide
HTKPDF

SEQ ID NO: 2522 - protein, 7 aa, Artificial Sequence
  Description of Artificial Sequence: Synthetic peptide
HTKPDRF

SEQ ID NO: 2523 - protein, 7 aa, Artificial Sequence
  Description of Artificial Sequence: Synthetic peptide
HTKPDFF

SEQ ID NO: 2524 - protein, 7 aa, Artificial Sequence
  Description of Artificial Sequence: Synthetic peptide
HTKPDYF

SEQ ID NO: 2525 - protein, 7 aa, Artificial Sequence
  Description of Artificial Sequence: Synthetic peptide
HTKPDHF

SEQ ID NO: 2526 - protein, 7 aa, Artificial Sequence
  Description of Artificial Sequence: Synthetic peptide
HTKPDPF

SEQ ID NO: 2527 - protein, 7 aa, Artificial Sequence
  Description of Artificial Sequence: Synthetic peptide
HTKPDKF

SEQ ID NO: 2528 - protein, 6 aa, Artificial Sequence
  Description of Artificial Sequence: Synthetic peptide
HTKPWF

SEQ ID NO: 2529 - protein, 7 aa, Artificial Sequence
  Description of Artificial Sequence: Synthetic peptide
HTKPWRF

SEQ ID NO: 2530 - protein, 7 aa, Artificial Sequence
  Description of Artificial Sequence: Synthetic peptide
HTKPWFF

SEQ ID NO: 2531 - protein, 7 aa, Artificial Sequence
  Description of Artificial Sequence: Synthetic peptide
HTKPWYF

SEQ ID NO: 2532 - protein, 7 aa, Artificial Sequence
  Description of Artificial Sequence: Synthetic peptide
HTKPWHF

SEQ ID NO: 2533 - protein, 7 aa, Artificial Sequence
  Description of Artificial Sequence: Synthetic peptide
HTKPWPF

SEQ ID NO: 2534 - protein, 7 aa, Artificial Sequence
  Description of Artificial Sequence: Synthetic peptide
HTKPWKF

SEQ ID NO: 2535 - protein, 6 aa, Artificial Sequence
  Description of Artificial Sequence: Synthetic peptide
HTKPQF

SEQ ID NO: 2536 - protein, 7 aa, Artificial Sequence
  Description of Artificial Sequence: Synthetic peptide
HTKPQRF

SEQ ID NO: 2537 - protein, 7 aa, Artificial Sequence
  Description of Artificial Sequence: Synthetic peptide
HTKPQFF

SEQ ID NO: 2538 - protein, 7 aa, Artificial Sequence
  Description of Artificial Sequence: Synthetic peptide
HTKPQYF

SEQ ID NO: 2539 - protein, 7 aa, Artificial Sequence
  Description of Artificial Sequence: Synthetic peptide
HTKPQHF

SEQ ID NO: 2540 - protein, 7 aa, Artificial Sequence
  Description of Artificial Sequence: Synthetic peptide
HTKPQPF

SEQ ID NO: 2541 - protein, 7 aa, Artificial Sequence
  Description of Artificial Sequence: Synthetic peptide
HTKPQKF

SEQ ID NO: 2542 - protein, 6 aa, Artificial Sequence
  Description of Artificial Sequence: Synthetic peptide
HTKPNF

SEQ ID NO: 2543 - protein, 7 aa, Artificial Sequence
  Description of Artificial Sequence: Synthetic peptide
HTKPNRF

SEQ ID NO: 2544 - protein, 7 aa, Artificial Sequence
  Description of Artificial Sequence: Synthetic peptide
HTKPNFF

SEQ ID NO: 2545 - protein, 7 aa, Artificial Sequence
  Description of Artificial Sequence: Synthetic peptide
HTKPNYF

SEQ ID NO: 2546 - protein, 7 aa, Artificial Sequence
  Description of Artificial Sequence: Synthetic peptide
HTKPNHF

SEQ ID NO: 2547 - protein, 7 aa, Artificial Sequence
  Description of Artificial Sequence: Synthetic peptide
HTKPNPF

SEQ ID NO: 2548 - protein, 7 aa, Artificial Sequence
  Description of Artificial Sequence: Synthetic peptide
HTKPNKF

SEQ ID NO: 2549 - protein, 6 aa, Artificial Sequence
  Description of Artificial Sequence: Synthetic peptide
HTKPYF

SEQ ID NO: 2550 - protein, 7 aa, Artificial Sequence
  Description of Artificial Sequence: Synthetic peptide
HTKPYRF

SEQ ID NO: 2551 - protein, 7 aa, Artificial Sequence
  Description of Artificial Sequence: Synthetic peptide
HTKPYFF

SEQ ID NO: 2552 - protein, 7 aa, Artificial Sequence
  Description of Artificial Sequence: Synthetic peptide
HTKPYYF

SEQ ID NO: 2553 - protein, 7 aa, Artificial Sequence
  Description of Artificial Sequence: Synthetic peptide
HTKPYHF

SEQ ID NO: 2554 - protein, 7 aa, Artificial Sequence
  Description of Artificial Sequence: Synthetic peptide
HTKPYPF

SEQ ID NO: 2555 - protein, 7 aa, Artificial Sequence
  Description of Artificial Sequence: Synthetic peptide
HTKPYKF

SEQ ID NO: 2556 - protein, 6 aa, Artificial Sequence
  Description of Artificial Sequence: Synthetic peptide
HTKPRF

SEQ ID NO: 2557 - protein, 7 aa, Artificial Sequence
  Description of Artificial Sequence: Synthetic peptide
HTKPRRF

SEQ ID NO: 2558 - protein, 7 aa, Artificial Sequence
  Description of Artificial Sequence: Synthetic peptide
HTKPRFF

SEQ ID NO: 2559 - protein, 7 aa, Artificial Sequence
  Description of Artificial Sequence: Synthetic peptide
HTKPRYF

SEQ ID NO: 2560 - protein, 7 aa, Artificial Sequence
  Description of Artificial Sequence: Synthetic peptide
HTKPRHF

SEQ ID NO: 2561 - protein, 7 aa, Artificial Sequence
  Description of Artificial Sequence: Synthetic peptide
HTKPRPF

SEQ ID NO: 2562 - protein, 7 aa, Artificial Sequence
  Description of Artificial Sequence: Synthetic peptide
HTKPRKF

SEQ ID NO: 2563 - protein, 5 aa, Artificial Sequence
  Description of Artificial Sequence: Synthetic peptide
KTKPF

SEQ ID NO: 2564 - protein, 6 aa, Artificial Sequence
  Description of Artificial Sequence: Synthetic peptide
KTKPRF

SEQ ID NO: 2565 - protein, 6 aa, Artificial Sequence
  Description of Artificial Sequence: Synthetic peptide
KTKPFF

SEQ ID NO: 2566 - protein, 6 aa, Artificial Sequence
  Description of Artificial Sequence: Synthetic peptide
KTKPYF

SEQ ID NO: 2567 - protein, 6 aa, Artificial Sequence
  Description of Artificial Sequence: Synthetic peptide
KTKPGF

SEQ ID NO: 2568 - protein, 6 aa, Artificial Sequence
  Description of Artificial Sequence: Synthetic peptide
KTKPHF

SEQ ID NO: 2569 - protein, 6 aa, Artificial Sequence
  Description of Artificial Sequence: Synthetic peptide
KTKPKF

SEQ ID NO: 2570 - protein, 6 aa, Artificial Sequence
  Description of Artificial Sequence: Synthetic peptide
KTKPGF

SEQ ID NO: 2571 - protein, 7 aa, Artificial Sequence
  Description of Artificial Sequence: Synthetic peptide
KTKPGRF

SEQ ID NO: 2572 - protein, 7 aa, Artificial Sequence
  Description of Artificial Sequence: Synthetic peptide
KTKPGFF

SEQ ID NO: 2573 - protein, 7 aa, Artificial Sequence
  Description of Artificial Sequence: Synthetic peptide
KTKPGYF

SEQ ID NO: 2574 - protein, 7 aa, Artificial Sequence
  Description of Artificial Sequence: Synthetic peptide
KTKPGHF

SEQ ID NO: 2575 - protein, 7 aa, Artificial Sequence
  Description of Artificial Sequence: Synthetic peptide
KTKPGPF

SEQ ID NO: 2576 - protein, 7 aa, Artificial Sequence
  Description of Artificial Sequence: Synthetic peptide
KTKPGKF

SEQ ID NO: 2577 - protein, 6 aa, Artificial Sequence
  Description of Artificial Sequence: Synthetic peptide
KTKPDF

SEQ ID NO: 2578 - protein, 7 aa, Artificial Sequence
  Description of Artificial Sequence: Synthetic peptide
KTKPDRF

SEQ ID NO: 2579 - protein, 7 aa, Artificial Sequence
  Description of Artificial Sequence: Synthetic peptide
KTKPDFF

SEQ ID NO: 2580 - protein, 7 aa, Artificial Sequence
  Description of Artificial Sequence: Synthetic peptide
KTKPDYF

SEQ ID NO: 2581 - protein, 7 aa, Artificial Sequence
  Description of Artificial Sequence: Synthetic peptide
KTKPDHF

SEQ ID NO: 2582 - protein, 7 aa, Artificial Sequence
  Description of Artificial Sequence: Synthetic peptide
KTKPDPF

SEQ ID NO: 2583 - protein, 7 aa, Artificial Sequence
  Description of Artificial Sequence: Synthetic peptide
KTKPDKF

SEQ ID NO: 2584 - protein, 6 aa, Artificial Sequence
  Description of Artificial Sequence: Synthetic peptide
KTKPWF

SEQ ID NO: 2585 - protein, 7 aa, Artificial Sequence
  Description of Artificial Sequence: Synthetic peptide
KTKPWRF

SEQ ID NO: 2586 - protein, 7 aa, Artificial Sequence
  Description of Artificial Sequence: Synthetic peptide
KTKPWFF

SEQ ID NO: 2587 - protein, 7 aa, Artificial Sequence
  Description of Artificial Sequence: Synthetic peptide
KTKPWYF

SEQ ID NO: 2588 - protein, 7 aa, Artificial Sequence
  Description of Artificial Sequence: Synthetic peptide
KTKPWHF

SEQ ID NO: 2589 - protein, 7 aa, Artificial Sequence
  Description of Artificial Sequence: Synthetic peptide
KTKPWPF

SEQ ID NO: 2590 - protein, 7 aa, Artificial Sequence
  Description of Artificial Sequence: Synthetic peptide
KTKPWKF

SEQ ID NO: 2591 - protein, 6 aa, Artificial Sequence
  Description of Artificial Sequence: Synthetic peptide
KTKPQF

SEQ ID NO: 2592 - protein, 7 aa, Artificial Sequence
  Description of Artificial Sequence: Synthetic peptide
KTKPQRF

SEQ ID NO: 2593 - protein, 7 aa, Artificial Sequence
  Description of Artificial Sequence: Synthetic peptide
KTKPQFF

SEQ ID NO: 2594 - protein, 7 aa, Artificial Sequence
  Description of Artificial Sequence: Synthetic peptide
KTKPQYF

SEQ ID NO: 2595 - protein, 7 aa, Artificial Sequence
  Description of Artificial Sequence: Synthetic peptide
KTKPQHF

SEQ ID NO: 2596 - protein, 7 aa, Artificial Sequence
  Description of Artificial Sequence: Synthetic peptide
KTKPQPF

SEQ ID NO: 2597 - protein, 7 aa, Artificial Sequence
  Description of Artificial Sequence: Synthetic peptide
KTKPQKF

SEQ ID NO: 2598 - protein, 6 aa, Artificial Sequence
  Description of Artificial Sequence: Synthetic peptide
KTKPNF

SEQ ID NO: 2599 - protein, 7 aa, Artificial Sequence
  Description of Artificial Sequence: Synthetic peptide
KTKPNRF

SEQ ID NO: 2600 - protein, 7 aa, Artificial Sequence
  Description of Artificial Sequence: Synthetic peptide
KTKPNFF

SEQ ID NO: 2601 - protein, 7 aa, Artificial Sequence
  Description of Artificial Sequence: Synthetic peptide
KTKPNYF

SEQ ID NO: 2602 - protein, 7 aa, Artificial Sequence
  Description of Artificial Sequence: Synthetic peptide
KTKPNHF

SEQ ID NO: 2603 - protein, 7 aa, Artificial Sequence
  Description of Artificial Sequence: Synthetic peptide
KTKPNPF

SEQ ID NO: 2604 - protein, 7 aa, Artificial Sequence
  Description of Artificial Sequence: Synthetic peptide
KTKPNKF

SEQ ID NO: 2605 - protein, 6 aa, Artificial Sequence
  Description of Artificial Sequence: Synthetic peptide
KTKPYF

SEQ ID NO: 2606 - protein, 7 aa, Artificial Sequence
  Description of Artificial Sequence: Synthetic peptide
KTKPYRF

SEQ ID NO: 2607 - protein, 7 aa, Artificial Sequence
  Description of Artificial Sequence: Synthetic peptide
KTKPYFF

SEQ ID NO: 2608 - protein, 7 aa, Artificial Sequence
  Description of Artificial Sequence: Synthetic peptide
KTKPYYF

SEQ ID NO: 2609 - protein, 7 aa, Artificial Sequence
  Description of Artificial Sequence: Synthetic peptide
KTKPYHF

SEQ ID NO: 2610 - protein, 7 aa, Artificial Sequence
  Description of Artificial Sequence: Synthetic peptide
KTKPYPF

SEQ ID NO: 2611 - protein, 7 aa, Artificial Sequence
  Description of Artificial Sequence: Synthetic peptide
KTKPYKF

SEQ ID NO: 2612 - protein, 6 aa, Artificial Sequence
  Description of Artificial Sequence: Synthetic peptide
KTKPRF

SEQ ID NO: 2613 - protein, 7 aa, Artificial Sequence
  Description of Artificial Sequence: Synthetic peptide
KTKPRRF

SEQ ID NO: 2614 - protein, 7 aa, Artificial Sequence
  Description of Artificial Sequence: Synthetic peptide
KTKPRFF

SEQ ID NO: 2615 - protein, 7 aa, Artificial Sequence
  Description of Artificial Sequence: Synthetic peptide
KTKPRYF

SEQ ID NO: 2616 - protein, 7 aa, Artificial Sequence
  Description of Artificial Sequence: Synthetic peptide
KTKPRHF

SEQ ID NO: 2617 - protein, 7 aa, Artificial Sequence
  Description of Artificial Sequence: Synthetic peptide
KTKPRPF

SEQ ID NO: 2618 - protein, 7 aa, Artificial Sequence
  Description of Artificial Sequence: Synthetic peptide
KTKPRKF

SEQ ID NO: 2619 - protein, 5 aa, Artificial Sequence
  Description of Artificial Sequence: Synthetic peptide
GTKPF

SEQ ID NO: 2620 - protein, 6 aa, Artificial Sequence
  Description of Artificial Sequence: Synthetic peptide
GTKPRF

SEQ ID NO: 2621 - protein, 6 aa, Artificial Sequence
  Description of Artificial Sequence: Synthetic peptide
GTKPFF

SEQ ID NO: 2622 - protein, 6 aa, Artificial Sequence
  Description of Artificial Sequence: Synthetic peptide
GTKPYF

SEQ ID NO: 2623 - protein, 6 aa, Artificial Sequence
  Description of Artificial Sequence: Synthetic peptide
GTKPGF

SEQ ID NO: 2624 - protein, 6 aa, Artificial Sequence
  Description of Artificial Sequence: Synthetic peptide
GTKPHF

SEQ ID NO: 2625 - protein, 6 aa, Artificial Sequence
  Description of Artificial Sequence: Synthetic peptide
GTKPKF

SEQ ID NO: 2626 - protein, 6 aa, Artificial Sequence
  Description of Artificial Sequence: Synthetic peptide
GTKPGF

SEQ ID NO: 2627 - protein, 7 aa, Artificial Sequence
  Description of Artificial Sequence: Synthetic peptide
GTKPGRF

SEQ ID NO: 2628 - protein, 7 aa, Artificial Sequence
  Description of Artificial Sequence: Synthetic peptide
GTKPGFF

SEQ ID NO: 2629 - protein, 7 aa, Artificial Sequence
  Description of Artificial Sequence: Synthetic peptide
GTKPGYF

SEQ ID NO: 2630 - protein, 7 aa, Artificial Sequence
  Description of Artificial Sequence: Synthetic peptide
GTKPGHF

SEQ ID NO: 2631 - protein, 7 aa, Artificial Sequence
  Description of Artificial Sequence: Synthetic peptide
GTKPGPF

SEQ ID NO: 2632 - protein, 7 aa, Artificial Sequence
  Description of Artificial Sequence: Synthetic peptide
GTKPGKF

SEQ ID NO: 2633 - protein, 6 aa, Artificial Sequence
  Description of Artificial Sequence: Synthetic peptide
GTKPDF

SEQ ID NO: 2634 - protein, 7 aa, Artificial Sequence
  Description of Artificial Sequence: Synthetic peptide
GTKPDRF

SEQ ID NO: 2635 - protein, 7 aa, Artificial Sequence
  Description of Artificial Sequence: Synthetic peptide
GTKPDFF

SEQ ID NO: 2636 - protein, 7 aa, Artificial Sequence
  Description of Artificial Sequence: Synthetic peptide
GTKPDYF

SEQ ID NO: 2637 - protein, 7 aa, Artificial Sequence
  Description of Artificial Sequence: Synthetic peptide
GTKPDHF

SEQ ID NO: 2638 - protein, 7 aa, Artificial Sequence
  Description of Artificial Sequence: Synthetic peptide
GTKPDPF

SEQ ID NO: 2639 - protein, 7 aa, Artificial Sequence
  Description of Artificial Sequence: Synthetic peptide
GTKPDKF

SEQ ID NO: 2640 - protein, 6 aa, Artificial Sequence
  Description of Artificial Sequence: Synthetic peptide
GTKPWF

SEQ ID NO: 2641 - protein, 7 aa, Artificial Sequence
  Description of Artificial Sequence: Synthetic peptide
GTKPWRF

SEQ ID NO: 2642 - protein, 7 aa, Artificial Sequence
  Description of Artificial Sequence: Synthetic peptide
GTKPWFF

SEQ ID NO: 2643 - protein, 7 aa, Artificial Sequence
  Description of Artificial Sequence: Synthetic peptide
GTKPWYF

SEQ ID NO: 2644 - protein, 7 aa, Artificial Sequence
  Description of Artificial Sequence: Synthetic peptide
GTKPWHF

SEQ ID NO: 2645 - protein, 7 aa, Artificial Sequence
  Description of Artificial Sequence: Synthetic peptide
GTKPWPF

SEQ ID NO: 2646 - protein, 7 aa, Artificial Sequence
  Description of Artificial Sequence: Synthetic peptide
GTKPWKF

SEQ ID NO: 2647 - protein, 6 aa, Artificial Sequence
  Description of Artificial Sequence: Synthetic peptide
GTKPQF

SEQ ID NO: 2648 - protein, 7 aa, Artificial Sequence
  Description of Artificial Sequence: Synthetic peptide
GTKPQRF

SEQ ID NO: 2649 - protein, 7 aa, Artificial Sequence
  Description of Artificial Sequence: Synthetic peptide
GTKPQFF

SEQ ID NO: 2650 - protein, 7 aa, Artificial Sequence
  Description of Artificial Sequence: Synthetic peptide
GTKPQYF

SEQ ID NO: 2651 - protein, 7 aa, Artificial Sequence
  Description of Artificial Sequence: Synthetic peptide
GTKPQHF

SEQ ID NO: 2652 - protein, 7 aa, Artificial Sequence
  Description of Artificial Sequence: Synthetic peptide
GTKPQPF

SEQ ID NO: 2653 - protein, 7 aa, Artificial Sequence
  Description of Artificial Sequence: Synthetic peptide
GTKPQKF

SEQ ID NO: 2654 - protein, 6 aa, Artificial Sequence
  Description of Artificial Sequence: Synthetic peptide
GTKPNF

SEQ ID NO: 2655 - protein, 7 aa, Artificial Sequence
  Description of Artificial Sequence: Synthetic peptide
GTKPNRF

SEQ ID NO: 2656 - protein, 7 aa, Artificial Sequence
  Description of Artificial Sequence: Synthetic peptide
GTKPNFF

SEQ ID NO: 2657 - protein, 7 aa, Artificial Sequence
  Description of Artificial Sequence: Synthetic peptide
GTKPNYF

SEQ ID NO: 2658 - protein, 7 aa, Artificial Sequence
  Description of Artificial Sequence: Synthetic peptide
GTKPNHF

SEQ ID NO: 2659 - protein, 7 aa, Artificial Sequence
  Description of Artificial Sequence: Synthetic peptide
GTKPNPF

SEQ ID NO: 2660 - protein, 7 aa, Artificial Sequence
  Description of Artificial Sequence: Synthetic peptide
GTKPNKF

SEQ ID NO: 2661 - protein, 6 aa, Artificial Sequence
  Description of Artificial Sequence: Synthetic peptide
GTKPYF

SEQ ID NO: 2662 - protein, 7 aa, Artificial Sequence
  Description of Artificial Sequence: Synthetic peptide
GTKPYRF

SEQ ID NO: 2663 - protein, 7 aa, Artificial Sequence
  Description of Artificial Sequence: Synthetic peptide
GTKPYFF

SEQ ID NO: 2664 - protein, 7 aa, Artificial Sequence
  Description of Artificial Sequence: Synthetic peptide
GTKPYYF

SEQ ID NO: 2665 - protein, 7 aa, Artificial Sequence
  Description of Artificial Sequence: Synthetic peptide
GTKPYHF

SEQ ID NO: 2666 - protein, 7 aa, Artificial Sequence
  Description of Artificial Sequence: Synthetic peptide
GTKPYPF

SEQ ID NO: 2667 - protein, 7 aa, Artificial Sequence
  Description of Artificial Sequence: Synthetic peptide
GTKPYKF

SEQ ID NO: 2668 - protein, 6 aa, Artificial Sequence
  Description of Artificial Sequence: Synthetic peptide
GTKPRF

SEQ ID NO: 2669 - protein, 7 aa, Artificial Sequence
  Description of Artificial Sequence: Synthetic peptide
GTKPRRF

SEQ ID NO: 2670 - protein, 7 aa, Artificial Sequence
  Description of Artificial Sequence: Synthetic peptide
GTKPRFF

SEQ ID NO: 2671 - protein, 7 aa, Artificial Sequence
  Description of Artificial Sequence: Synthetic peptide
GTKPRYF

SEQ ID NO: 2672 - protein, 7 aa, Artificial Sequence
  Description of Artificial Sequence: Synthetic peptide
GTKPRHF

SEQ ID NO: 2673 - protein, 7 aa, Artificial Sequence
  Description of Artificial Sequence: Synthetic peptide
GTKPRPF

SEQ ID NO: 2674 - protein, 7 aa, Artificial Sequence
  Description of Artificial Sequence: Synthetic peptide
GTKPRKF

SEQ ID NO: 2675 - protein, 5 aa, Artificial Sequence
  Description of Artificial Sequence: Synthetic peptide
PRPGP

SEQ ID NO: 2676 - protein, 4 aa, Artificial Sequence
  Description of Artificial Sequence: Synthetic peptide
RPGP

SEQ ID NO: 2677 - protein, 3 aa, Artificial Sequence
  Description of Artificial Sequence: Synthetic peptide
PGP

SEQ ID NO: 2678 - protein, 2 aa, Artificial Sequence
  Description of Artificial Sequence: Synthetic peptide
TK

SEQ ID NO: 2679 - protein, 4 aa, Artificial Sequence
  Description of Artificial Sequence: Synthetic peptide
TKPF

SEQ ID NO: 2680 - protein, 7 aa, Artificial Sequence
  Description of Artificial Sequence: Synthetic peptide
TKPRPGP

The invention claimed is:

1. A pharmaceutical composition comprising a peptide consisting of formula:

A-Thr-Lys-Pro-B-C-D-X, wherein:
  A is absent, Met, Met(O), Thr, Ala, His, Phe, Lys, Gly;
  B is absent, Gly, Asp, Trp, Gln, Asn, Tyr, Pro, Arg;
  C is absent, Arg, Phe, Tyr, Gly, His, Pro;
  D is absent, Val, Tyr, Trp, Phe, His;
  X is a carboxy terminal OH, OCH$_3$, or NH$_2$ group,
provided that (i) when A is present, at least one of B, C, or D is also present, or when B is present, then C and/or D is also present and (ii) the peptide is not a tetrapeptide and is not Thr-Lys-Pro-X (SEQ ID NO: 5), Phe-Thr-Lys-Pro-Gly-X (SEQ ID NO: 1), Thr-Lys-Pro-Pro-Arg-X (SEQ ID NO: 2), Thr-Thr-Lys-Pro-Arg-X (SEQ ID NO: 607), Lys-Thr-Lys-Pro-Arg-X (SEQ ID NO: 772), Thr-Lys-Pro-Gly-Pro-X (SEQ ID NO: 460), Thr-Lys-Pro-Gly-Arg-X (SEQ ID NO: 456), Thr-Lys-Pro-Arg-Tyr (SEQ ID NO: 494), or Thr-Lys-Pro-Arg-Gly-X (SEQ ID NO: 3), wherein said peptide is present in the composition in an amount effective for stimulating sexual or reproductive function.

2. The pharmaceutical composition of claim 1, wherein said peptide is produced by expression in a recombinant microorganism.

3. The pharmaceutical composition of claim 1, wherein said peptide is produced by chemical synthesis.

4. A pharmaceutical composition comprising a peptide consisting of the formula Thr-Lys-Pro-Arg-Pro-X (SEQ ID NO: 6), wherein X is a carboxy terminal OH, OCH$_3$, or NH$_2$ group, and wherein said peptide is present in the composition in an amount effective for stimulating sexual or reproductive function.

5. The pharmaceutical composition of claim 4, wherein said peptide is produced by expression in a recombinant microorganism.

6. The pharmaceutical composition of claim 4, wherein said peptide is produced by chemical synthesis.

7. A pharmaceutical composition comprising a peptide consisting of the formula Thr-Lys-Pro-Arg-Pro-Phe-X (SEQ ID NO: 7), wherein X is a carboxy terminal OH, OCH$_3$, or NH$_2$ group, and wherein said peptide is present in the composition in an amount effective for stimulating sexual or reproductive function.

8. The pharmaceutical composition of claim 7, wherein said peptide is produced by expression in a recombinant microorganism.

9. The pharmaceutical composition of claim 7, wherein said peptide is produced by chemical synthesis.

10. A pharmaceutical composition comprising a peptide consisting of the formula Thr-Lys-Pro-B-C-X, wherein B is Arg, Gln, or Asn, and C is Pro, Gly, or Phe, wherein X is a carboxy terminal OH, OCH$_3$, or NH$_2$ group, wherein said peptide is not Thr-Lys-Pro-Arg-Gly-X (SEQ ID NO: 3), and wherein said peptide is present in the composition in an amount effective for stimulating sexual or reproductive function.

11. The pharmaceutical composition of claim 10, wherein said peptide is produced by expression in a recombinant microorganism.

12. The pharmaceutical composition of claim 10 wherein said peptide is produced by chemical synthesis.

13. A pharmaceutical composition comprising a peptide consisting of the formula A-Thr-Lys-Pro-B-C-X, wherein:
  A is Met, Thr, Ala, His, Phe, Lys, or Gly;
  B is Arg, Gln, or Asn, and
  C is Pro, Gly, or Phe,
wherein X is a carboxy terminal OH, OCH$_3$, or NH$_2$ group, and wherein said peptide is present in the composition in an amount effective for stimulating sexual or reproductive function.

14. The pharmaceutical composition of claim 13, wherein said peptide is produced by expression in a recombinant microorganism.

15. The pharmaceutical composition of claim 13, wherein said peptide is produced by chemical synthesis.

16. A pharmaceutical composition comprising a peptide consisting of the formula A-Thr-Lys-Pro-B-C-D-X, wherein:
  A is Met, Thr, Ala, His, Phe, Lys, or Gly;
  B is Arg, Gln, or Asn;
  C is Pro, Gly, or Phe, and
  D is Val, Gly, Tyr, Trp, Phe, or His,
wherein X is a carboxy terminal OH, OCH$_3$, or NH$_2$ group, and wherein said peptide is present in the composition in an amount effective for stimulating sexual or reproductive function.

17. The pharmaceutical composition of claim 16, wherein said peptide is produced by expression in a recombinant microorganism.

18. The pharmaceutical composition of claim 16, wherein said peptide is produced by chemical synthesis.

19. A method for stimulating sexual or reproductive function in a mammal in need thereof comprising administering to said mammal the pharmaceutical composition of claim 1.

20. The method of claim 19, wherein the mammal has a reproductive or sexual dysfunction.

21. A method for treating a reproductive or sexual dysfunction in a mammal in need of such treatment comprising administering to said mammal the pharmaceutical composition of claim 1.

22. A method for stimulating sexual or reproductive function in a mammal in need thereof comprising administering to said mammal the pharmaceutical composition of claim 4.

23. The method of claim 22, wherein the mammal has a reproductive or sexual dysfunction.

24. A method for treating a reproductive or sexual dysfunction in a mammal in need of such treatment comprising administering to said mammal the pharmaceutical composition of claim 4.

25. A method for stimulating sexual or reproductive function in a mammal in need thereof comprising administering to said mammal the pharmaceutical composition of claim 7.

26. The method of claim 25, wherein the mammal has a reproductive or sexual dysfunction.

27. A method for treating a reproductive or sexual dysfunction in a mammal in need of such treatment comprising administering to said mammal the pharmaceutical composition of claim 7.

28. A method for stimulating sexual or reproductive function in a mammal in need thereof comprising administering to said mammal the pharmaceutical composition of claim 10.

29. The method of claim 28, wherein the mammal has a reproductive or sexual dysfunction.

30. A method for treating a reproductive or sexual dysfunction in a mammal in need of such treatment comprising administering to said mammal the pharmaceutical composition of claim 10.

31. A method for stimulating sexual or reproductive function in a mammal in need thereof comprising administering to said mammal the pharmaceutical composition of claim 13.

32. The method of claim 31, wherein the mammal has a reproductive or sexual dysfunction.

33. A method for treating a reproductive or sexual dysfunction in a mammal in need of such treatment comprising administering to said mammal the pharmaceutical composition of claim 13.

34. A method for stimulating sexual or reproductive function in a mammal in need thereof comprising administering to said mammal the pharmaceutical composition of claim 16.

35. The method of claim 34, wherein the mammal has a reproductive or sexual dysfunction.

36. A method for treating a reproductive or sexual dysfunction in a mammal in need of such treatment comprising administering to said mammal the pharmaceutical composition of claim 16.

* * * * *